United States Patent 12,185,725 (BCA CONTROL OF STB) - sequence listing, part 72

SEQ ID NO: 3 - DNA, 56886990 bp, Clonostachys rosea (residues 20,316,791-22,348,469 of 56,886,990)
  misc_feature (693245)..(693262): n is a, c, g, or t
  misc_feature (1136936)..(1137109): n is a, c, g, or t
  misc_feature (1879228)..(1879228): n is a, c, g, or t
  misc_feature (2190065)..(2190088): n is a, c, g, or t
  misc_feature (2746883)..(2746883): n is a, c, g, or t
  misc_feature (3007180)..(3007183): n is a, c, g, or t
  misc_feature (3476025)..(3476025): n is a, c, g, or t
  misc_feature (3480465)..(3480465): n is a, c, g, or t
  misc_feature (3481131)..(3481134): n is a, c, g, or t
  misc_feature (3593846)..(3593846): n is a, c, g, or t
  misc_feature (3665987)..(3665997): n is a, c, g, or t
  misc_feature (3736325)..(3736333): n is a, c, g, or t
  misc_feature (3736881)..(3736976): n is a, c, g, or t
  misc_feature (3771550)..(3771550): n is a, c, g, or t
  misc_feature (3805190)..(3805269): n is a, c, g, or t
  misc_feature (3805986)..(3806020): n is a, c, g, or t
  misc_feature (3965540)..(3965554): n is a, c, g, or t
  misc_feature (4018857)..(4018858): n is a, c, g, or t
  misc_feature (4162501)..(4162501): n is a, c, g, or t
  misc_feature (4742450)..(4742450): n is a, c, g, or t
  misc_feature (4998262)..(4998262): n is a, c, g, or t
  misc_feature (5060557)..(5060736): n is a, c, g, or t
  misc_feature (5062427)..(5062461): n is a, c, g, or t
  misc_feature (5775743)..(5775744): n is a, c, g, or t
  misc_feature (5947223)..(5947238): n is a, c, g, or t
  misc_feature (5960277)..(5960300): n is a, c, g, or t
  misc_feature (5962015)..(5962068): n is a, c, g, or t
  misc_feature (6018885)..(6018895): n is a, c, g, or t
  misc_feature (6605255)..(6605276): n is a, c, g, or t
  misc_feature (7220677)..(7220678): n is a, c, g, or t
  misc_feature (7256437)..(7256440): n is a, c, g, or t
  misc_feature (7294376)..(7294420): n is a, c, g, or t
  misc_feature (7359775)..(7359811): n is a, c, g, or t
  misc_feature (7361217)..(7361247): n is a, c, g, or t
  misc_feature (7363174)..(7363188): n is a, c, g, or t
  misc_feature (7366102)..(7366128): n is a, c, g, or t
  misc_feature (7833929)..(7833983): n is a, c, g, or t
  misc_feature (7843586)..(7843608): n is a, c, g, or t
  misc_feature (7948777)..(7948777): n is a, c, g, or t
  misc_feature (8005832)..(8005832): n is a, c, g, or t
  misc_feature (8049837)..(8049837): n is a, c, g, or t
  misc_feature (8241740)..(8241760): n is a, c, g, or t
  misc_feature (8368460)..(8368460): n is a, c, g, or t
  misc_feature (8469490)..(8469524): n is a, c, g, or t
  misc_feature (8478934)..(8479048): n is a, c, g, or t
  misc_feature (8485047)..(8485128): n is a, c, g, or t
  misc_feature (8495560)..(8495613): n is a, c, g, or t
  misc_feature (11022761)..(11022761): n is a, c, g, or t
  misc_feature (11892568)..(11892589): n is a, c, g, or t
  misc_feature (12428314)..(12428316): n is a, c, g, or t
  misc_feature (12447065)..(12447065): n is a, c, g, or t
  misc_feature (12448449)..(12448483): n is a, c, g, or t
  misc_feature (12464693)..(12464719): n is a, c, g, or t
  misc_feature (12576391)..(12576411): n is a, c, g, or t
  misc_feature (12587520)..(12587542): n is a, c, g, or t
  misc_feature (12625647)..(12625650): n is a, c, g, or t
  misc_feature (12974521)..(12974556): n is a, c, g, or t
  misc_feature (12977882)..(12977921): n is a, c, g, or t
  misc_feature (13304308)..(13304308): n is a, c, g, or t
  misc_feature (13320027)..(13320043): n is a, c, g, or t
  misc_feature (13791828)..(13791838): n is a, c, g, or t
  misc_feature (13959638)..(13959723): n is a, c, g, or t
  misc_feature (13964441)..(13964442): n is a, c, g, or t
  misc_feature (13968670)..(13968671): n is a, c, g, or t
  misc_feature (14052108)..(14052172): n is a, c, g, or t
  misc_feature (14129762)..(14129871): n is a, c, g, or t
  misc_feature (14131331)..(14131370): n is a, c, g, or t
  misc_feature (14405262)..(14405452): n is a, c, g, or t
  misc_feature (14413193)..(14413215): n is a, c, g, or t
  misc_feature (14423182)..(14423238): n is a, c, g, or t
  misc_feature (14428043)..(14428219): n is a, c, g, or t
  misc_feature (14764712)..(14764744): n is a, c, g, or t
  misc_feature (15725146)..(15725146): n is a, c, g, or t
  misc_feature (16196469)..(16196488): n is a, c, g, or t
  misc_feature (16544810)..(16544810): n is a, c, g, or t
  misc_feature (16557831)..(16557831): n is a, c, g, or t
  misc_feature (16578655)..(16578664): n is a, c, g, or t
  misc_feature (16671120)..(16671149): n is a, c, g, or t
  misc_feature (16797188)..(16797229): n is a, c, g, or t
  misc_feature (17097935)..(17097938): n is a, c, g, or t
  misc_feature (17098668)..(17098683): n is a, c, g, or t
  misc_feature (17424753)..(17424753): n is a, c, g, or t
  misc_feature (17474349)..(17474349): n is a, c, g, or t
  misc_feature (17517033)..(17517033): n is a, c, g, or t
  misc_feature (17540325)..(17540386): n is a, c, g, or t
  misc_feature (17545055)..(17545066): n is a, c, g, or t
  misc_feature (17926562)..(17926638): n is a, c, g, or t
  misc_feature (17942705)..(17942794): n is a, c, g, or t
  misc_feature (17970904)..(17970957): n is a, c, g, or t
  misc_feature (17972432)..(17972432): n is a, c, g, or t
  misc_feature (18425126)..(18425136): n is a, c, g, or t
  misc_feature (18517150)..(18517150): n is a, c, g, or t
  misc_feature (18872613)..(18872698): n is a, c, g, or t
  misc_feature (18876890)..(18876929): n is a, c, g, or t
  misc_feature (18879913)..(18879952): n is a, c, g, or t
  misc_feature (18883169)..(18883208): n is a, c, g, or t
  misc_feature (19059868)..(19059893): n is a, c, g, or t
  misc_feature (19146577)..(19146585): n is a, c, g, or t
  misc_feature (19254458)..(19254526): n is a, c, g, or t
  misc_feature (19324159)..(19324245): n is a, c, g, or t
  misc_feature (19372066)..(19372129): n is a, c, g, or t
  misc_feature (19602854)..(19602868): n is a, c, g, or t
  misc_feature (19911091)..(19911091): n is a, c, g, or t
  misc_feature (20112904)..(20112948): n is a, c, g, or t
  misc_feature (20125037)..(20125068): n is a, c, g, or t
  misc_feature (20403377)..(20403474): n is a, c, g, or t
  misc_feature (20411500)..(20411546): n is a, c, g, or t
  misc_feature (20419017)..(20419074): n is a, c, g, or t
  misc_feature (20429032)..(20429033): n is a, c, g, or t
  misc_feature (20613047)..(20613061): n is a, c, g, or t
  misc_feature (20615137)..(20615327): n is a, c, g, or t
  misc_feature (20615731)..(20615771): n is a, c, g, or t
  misc_feature (20637759)..(20637759): n is a, c, g, or t
  misc_feature (20891045)..(20891045): n is a, c, g, or t
  misc_feature (21028563)..(21028571): n is a, c, g, or t
  misc_feature (21267880)..(21267880): n is a, c, g, or t
  misc_feature (21664562)..(21664562): n is a, c, g, or t
  misc_feature (22258221)..(22258243): n is a, c, g, or t
  misc_feature (22319165)..(22319224): n is a, c, g, or t
  misc_feature (22352514)..(22352514): n is a, c, g, or t
  misc_feature (22361298)..(22361308): n is a, c, g, or t
  misc_feature (23941898)..(23942012): n is a, c, g, or t
  misc_feature (24314297)..(24314416): n is a, c, g, or t
  misc_feature (24368093)..(24368093): n is a, c, g, or t
  misc_feature (24422028)..(24422057): n is a, c, g, or t
  misc_feature (24570330)..(24570452): n is a, c, g, or t
  misc_feature (24748636)..(24748643): n is a, c, g, or t
  misc_feature (25540118)..(25540118): n is a, c, g, or t
  misc_feature (25680515)..(25680579): n is a, c, g, or t
  misc_feature (26243820)..(26243822): n is a, c, g, or t
  misc_feature (26268780)..(26268811): n is a, c, g, or t
  misc_feature (26462837)..(26462911): n is a, c, g, or t
  misc_feature (26753189)..(26753189): n is a, c, g, or t
  misc_feature (27070440)..(27070466): n is a, c, g, or t
  misc_feature (27349660)..(27349725): n is a, c, g, or t
  misc_feature (27366668)..(27366683): n is a, c, g, or t
  misc_feature (27387101)..(27387279): n is a, c, g, or t
  misc_feature (28401989)..(28402045): n is a, c, g, or t
  misc_feature (28907378)..(28907378): n is a, c, g, or t
  misc_feature (29355954)..(29355978): n is a, c, g, or t
  misc_feature (29358090)..(29358090): n is a, c, g, or t
  misc_feature (29358565)..(29358565): n is a, c, g, or t
  misc_feature (29383247)..(29383247): n is a, c, g, or t
  misc_feature (29388517)..(29388525): n is a, c, g, or t
  misc_feature (29513530)..(29513556): n is a, c, g, or t
  misc_feature (29735789)..(29735789): n is a, c, g, or t
  misc_feature (29735991)..(29736064): n is a, c, g, or t
  misc_feature (29736935)..(29736935): n is a, c, g, or t
  misc_feature (29737541)..(29737681): n is a, c, g, or t
  misc_feature (29738650)..(29738699): n is a, c, g, or t
  misc_feature (29740640)..(29740689): n is a, c, g, or t
  misc_feature (29746493)..(29746547): n is a, c, g, or t
  misc_feature (29746880)..(29746929): n is a, c, g, or t
  misc_feature (29755192)..(29755258): n is a, c, g, or t
  misc_feature (29765335)..(29765397): n is a, c, g, or t
  misc_feature (29773014)..(29773182): n is a, c, g, or t
  misc_feature (29780536)..(29780536): n is a, c, g, or t
  misc_feature (29780814)..(29780863): n is a, c, g, or t
  misc_feature (29781388)..(29781437): n is a, c, g, or t
  misc_feature (29784219)..(29784268): n is a, c, g, or t
  misc_feature (29784993)..(29784993): n is a, c, g, or t
  misc_feature (29785294)..(29785343): n is a, c, g, or t
  misc_feature (29787283)..(29787283): n is a, c, g, or t
  misc_feature (29787499)..(29787548): n is a, c, g, or t
  misc_feature (29957714)..(29957763): n is a, c, g, or t
  misc_feature (29957996)..(29958045): n is a, c, g, or t
  misc_feature (30142107)..(30142127): n is a, c, g, or t
  misc_feature (30250347)..(30250376): n is a, c, g, or t
  misc_feature (30360982)..(30361057): n is a, c, g, or t
  misc_feature (30778172)..(30778216): n is a, c, g, or t
  misc_feature (30975755)..(30975755): n is a, c, g, or t
  misc_feature (30976003)..(30976052): n is a, c, g, or t
  misc_feature (30977134)..(30977185): n is a, c, g, or t
  misc_feature (30978365)..(30978365): n is a, c, g, or t
  misc_feature (30980042)..(30980091): n is a, c, g, or t
  misc_feature (30980366)..(30980366): n is a, c, g, or t
  misc_feature (30980604)..(30980653): n is a, c, g, or t
  misc_feature (30982016)..(30982065): n is a, c, g, or t
  misc_feature (30986349)..(30986398): n is a, c, g, or t
  misc_feature (30989034)..(30989083): n is a, c, g, or t
  misc_feature (30989319)..(30989319): n is a, c, g, or t
  misc_feature (30989855)..(30989904): n is a, c, g, or t
  misc_feature (30991981)..(30992030): n is a, c, g, or t
  misc_feature (30992255)..(30992304): n is a, c, g, or t
  misc_feature (30993777)..(30993826): n is a, c, g, or t
  misc_feature (30994139)..(30994188): n is a, c, g, or t
  misc_feature (30994389)..(30994466): n is a, c, g, or t
  misc_feature (30998022)..(30998071): n is a, c, g, or t
  misc_feature (30998266)..(30998304): n is a, c, g, or t
  misc_feature (30998881)..(30998881): n is a, c, g, or t
  misc_feature (30999118)..(30999196): n is a, c, g, or t
  misc_feature (30999740)..(30999740): n is a, c, g, or t
  misc_feature (30999954)..(31000003): n is a, c, g, or t
  misc_feature (31004879)..(31004928): n is a, c, g, or t
  misc_feature (31006072)..(31006121): n is a, c, g, or t
  misc_feature (31007262)..(31007311): n is a, c, g, or t
  misc_feature (31008071)..(31008134): n is a, c, g, or t
  misc_feature (31008537)..(31008547): n is a, c, g, or t
  misc_feature (31009544)..(31009584): n is a, c, g, or t
  misc_feature (31010041)..(31010041): n is a, c, g, or t
  misc_feature (31010260)..(31010309): n is a, c, g, or t
  misc_feature (31011714)..(31011714): n is a, c, g, or t
  misc_feature (31013588)..(31013637): n is a, c, g, or t
  misc_feature (31023759)..(31023759): n is a, c, g, or t
  misc_feature (31024054)..(31024112): n is a, c, g, or t
  misc_feature (31024779)..(31024779): n is a, c, g, or t
  misc_feature (31024994)..(31025043): n is a, c, g, or t
  misc_feature (31027046)..(31027046): n is a, c, g, or t
  misc_feature (31027282)..(31027331): n is a, c, g, or t
  misc_feature (31028354)..(31028354): n is a, c, g, or t
  misc_feature (31029562)..(31029611): n is a, c, g, or t
  misc_feature (31030082)..(31030131): n is a, c, g, or t
  misc_feature (31033531)..(31033582): n is a, c, g, or t
  misc_feature (31055817)..(31055817): n is a, c, g, or t
  misc_feature (31056024)..(31056073): n is a, c, g, or t
  misc_feature (31056844)..(31056945): n is a, c, g, or t
  misc_feature (31057207)..(31057256): n is a, c, g, or t
  misc_feature (31057836)..(31057885): n is a, c, g, or t
  misc_feature (31058678)..(31058727): n is a, c, g, or t
  misc_feature (31058934)..(31058934): n is a, c, g, or t
  misc_feature (31059187)..(31059236): n is a, c, g, or t
  misc_feature (31059851)..(31059900): n is a, c, g, or t
  misc_feature (31061067)..(31061116): n is a, c, g, or t
  misc_feature (31061805)..(31061805): n is a, c, g, or t
  misc_feature (31062045)..(31062094): n is a, c, g, or t
  misc_feature (31080878)..(31080885): n is a, c, g, or t
  misc_feature (31110649)..(31110649): n is a, c, g, or t
  misc_feature (31110856)..(31110905): n is a, c, g, or t
  misc_feature (31112833)..(31112833): n is a, c, g, or t
  misc_feature (31113307)..(31113356): n is a, c, g, or t
  misc_feature (31139217)..(31139217): n is a, c, g, or t
  misc_feature (31139626)..(31139675): n is a, c, g, or t
  misc_feature (31142542)..(31142591): n is a, c, g, or t
  misc_feature (31143224)..(31143273): n is a, c, g, or t
  misc_feature (31143530)..(31143530): n is a, c, g, or t
  misc_feature (31143867)..(31143916): n is a, c, g, or t
  misc_feature (31145524)..(31145524): n is a, c, g, or t
  misc_feature (31145730)..(31145779): n is a, c, g, or t
  misc_feature (31146716)..(31146801): n is a, c, g, or t
  misc_feature (31282758)..(31282758): n is a, c, g, or t
  misc_feature (31574282)..(31574282): n is a, c, g, or t
  misc_feature (31585750)..(31585799): n is a, c, g, or t
  misc_feature (31883943)..(31883943): n is a, c, g, or t
  misc_feature (31884158)..(31884207): n is a, c, g, or t
  misc_feature (31885290)..(31885339): n is a, c, g, or t
  misc_feature (31885550)..(31885629): n is a, c, g, or t
  misc_feature (31886735)..(31886784): n is a, c, g, or t
  misc_feature (31887165)..(31887168): n is a, c, g, or t
  misc_feature (31915893)..(31915942): n is a, c, g, or t
  misc_feature (32007898)..(32007912): n is a, c, g, or t
  misc_feature (32064409)..(32064409): n is a, c, g, or t
  misc_feature (32244074)..(32244123): n is a, c, g, or t
  misc_feature (32289810)..(32289859): n is a, c, g, or t
  misc_feature (32290042)..(32290112): n is a, c, g, or t
  misc_feature (32291295)..(32291295): n is a, c, g, or t
  misc_feature (32291498)..(32291547): n is a, c, g, or t
  misc_feature (32292139)..(32292188): n is a, c, g, or t
  misc_feature (32294367)..(32294416): n is a, c, g, or t
  misc_feature (32294971)..(32295020): n is a, c, g, or t
  misc_feature (32296451)..(32296465): n is a, c, g, or t
  misc_feature (32296832)..(32296881): n is a, c, g, or t
  misc_feature (32298905)..(32298954): n is a, c, g, or t
  misc_feature (32299308)..(32299357): n is a, c, g, or t
  misc_feature (32303281)..(32303330): n is a, c, g, or t
  misc_feature (32304167)..(32304216): n is a, c, g, or t
  misc_feature (32304429)..(32304429): n is a, c, g, or t
  misc_feature (32304646)..(32304695): n is a, c, g, or t
  misc_feature (32305263)..(32305263): n is a, c, g, or t
  misc_feature (32305530)..(32305579): n is a, c, g, or t
  misc_feature (32307517)..(32307566): n is a, c, g, or t
  misc_feature (32308733)..(32308782): n is a, c, g, or t
  misc_feature (32308912)..(32308990): n is a, c, g, or t
  misc_feature (32310082)..(32310131): n is a, c, g, or t
  misc_feature (32310334)..(32310383): n is a, c, g, or t
  misc_feature (32311218)..(32311267): n is a, c, g, or t
  misc_feature (32311726)..(32311775): n is a, c, g, or t
  misc_feature (32407571)..(32407620): n is a, c, g, or t
  misc_feature (32410129)..(32410186): n is a, c, g, or t
  misc_feature (32412009)..(32412058): n is a, c, g, or t
  misc_feature (32412427)..(32412427): n is a, c, g, or t
  misc_feature (32412723)..(32412787): n is a, c, g, or t
  misc_feature (32413618)..(32413669): n is a, c, g, or t
  misc_feature (32422549)..(32422598): n is a, c, g, or t
  misc_feature (32422864)..(32422913): n is a, c, g, or t
  misc_feature (32423144)..(32423144): n is a, c, g, or t
  misc_feature (32423643)..(32423692): n is a, c, g, or t
  misc_feature (32430887)..(32430887): n is a, c, g, or t
  misc_feature (32431105)..(32431154): n is a, c, g, or t
  misc_feature (32431981)..(32431981): n is a, c, g, or t
  misc_feature (32432199)..(32432252): n is a, c, g, or t
  misc_feature (32434015)..(32434064): n is a, c, g, or t
  misc_feature (32434277)..(32434326): n is a, c, g, or t
  misc_feature (32436342)..(32436342): n is a, c, g, or t
  misc_feature (32436630)..(32436679): n is a, c, g, or t
  misc_feature (32437516)..(32437516): n is a, c, g, or t
  misc_feature (32437785)..(32437853): n is a, c, g, or t
  misc_feature (32440601)..(32440646): n is a, c, g, or t
  misc_feature (32447118)..(32447126): n is a, c, g, or t
  misc_feature (32448756)..(32448813): n is a, c, g, or t
  misc_feature (32448918)..(32448918): n is a, c, g, or t
  misc_feature (32449156)..(32449205): n is a, c, g, or t
  misc_feature (32449432)..(32449432): n is a, c, g, or t
  misc_feature (32449673)..(32449722): n is a, c, g, or t
  misc_feature (32491985)..(32491985): n is a, c, g, or t
  misc_feature (32492251)..(32492314): n is a, c, g, or t
  misc_feature (32501761)..(32501813): n is a, c, g, or t
  misc_feature (32503408)..(32503457): n is a, c, g, or t
  misc_feature (32503894)..(32503905): n is a, c, g, or t
  misc_feature (32515416)..(32515465): n is a, c, g, or t
  misc_feature (32524203)..(32524252): n is a, c, g, or t
  misc_feature (32525850)..(32525850): n is a, c, g, or t
  misc_feature (32526162)..(32526211): n is a, c, g, or t
  misc_feature (32526322)..(32526365): n is a, c, g, or t
  misc_feature (32526930)..(32526979): n is a, c, g, or t
  misc_feature (32529016)..(32529065): n is a, c, g, or t
  misc_feature (32529746)..(32529795): n is a, c, g, or t
  misc_feature (32625487)..(32625487): n is a, c, g, or t
  misc_feature (32708566)..(32708566): n is a, c, g, or t
  misc_feature (33057470)..(33057470): n is a, c, g, or t
  misc_feature (33277921)..(33277921): n is a, c, g, or t
  misc_feature (33285056)..(33285056): n is a, c, g, or t
  misc_feature (33285288)..(33285353): n is a, c, g, or t
  misc_feature (33286482)..(33286531): n is a, c, g, or t
  misc_feature (33286902)..(33286988): n is a, c, g, or t
  misc_feature (33289500)..(33289500): n is a, c, g, or t
  misc_feature (33289992)..(33290041): n is a, c, g, or t
  misc_feature (33292826)..(33292875): n is a, c, g, or t
  misc_feature (33570139)..(33570155): n is a, c, g, or t
  misc_feature (34302303)..(34302316): n is a, c, g, or t
  misc_feature (34704191)..(34704191): n is a, c, g, or t
  misc_feature (35012138)..(35012140): n is a, c, g, or t
  misc_feature (35413133)..(35413167): n is a, c, g, or t
  misc_feature (35641676)..(35641695): n is a, c, g, or t
  misc_feature (35804468)..(35804517): n is a, c, g, or t
  misc_feature (35947130)..(35947154): n is a, c, g, or t
  misc_feature (36170253)..(36170261): n is a, c, g, or t
  misc_feature (36199036)..(36199036): n is a, c, g, or t
  misc_feature (36200584)..(36200633): n is a, c, g, or t
  misc_feature (36200806)..(36200855): n is a, c, g, or t
  misc_feature (36203088)..(36203088): n is a, c, g, or t
  misc_feature (36215162)..(36215211): n is a, c, g, or t
  misc_feature (36216400)..(36216439): n is a, c, g, or t
  misc_feature (36216541)..(36216541): n is a, c, g, or t
  misc_feature (36216981)..(36217030): n is a, c, g, or t
  misc_feature (36217853)..(36217853): n is a, c, g, or t
  misc_feature (36219239)..(36219288): n is a, c, g, or t
  misc_feature (36219784)..(36219784): n is a, c, g, or t
  misc_feature (36221052)..(36221101): n is a, c, g, or t
  misc_feature (36358974)..(36358974): n is a, c, g, or t
  misc_feature (36364353)..(36364397): n is a, c, g, or t
  misc_feature (36364662)..(36364711): n is a, c, g, or t
  misc_feature (36384990)..(36384990): n is a, c, g, or t
  misc_feature (36385913)..(36385962): n is a, c, g, or t
  misc_feature (36386362)..(36386423): n is a, c, g, or t
  misc_feature (36386682)..(36386682): n is a, c, g, or t
  misc_feature (36413265)..(36413314): n is a, c, g, or t
  misc_feature (36414643)..(36414643): n is a, c, g, or t
  misc_feature (36425629)..(36425629): n is a, c, g, or t
  misc_feature (36431343)..(36431373): n is a, c, g, or t
  misc_feature (36433078)..(36433127): n is a, c, g, or t
  misc_feature (36439628)..(36439628): n is a, c, g, or t
  misc_feature (36440308)..(36440357): n is a, c, g, or t
  misc_feature (36733661)..(36733710): n is a, c, g, or t
  misc_feature (37214506)..(37214555): n is a, c, g, or t
  misc_feature (37368744)..(37368744): n is a, c, g, or t
  misc_feature (37414774)..(37414847): n is a, c, g, or t
  misc_feature (37777911)..(37777926): n is a, c, g, or t
  misc_feature (38006024)..(38006024): n is a, c, g, or t
  misc_feature (38006234)..(38006283): n is a, c, g, or t
  misc_feature (38309894)..(38309904): n is a, c, g, or t
  misc_feature (38378504)..(38378553): n is a, c, g, or t
  misc_feature (38469007)..(38469056): n is a, c, g, or t
  misc_feature (38541001)..(38541024): n is a, c, g, or t
  misc_feature (38542669)..(38542718): n is a, c, g, or t
  misc_feature (38615417)..(38615545): n is a, c, g, or t
  misc_feature (38642223)..(38642438): n is a, c, g, or t
  misc_feature (38644660)..(38644660): n is a, c, g, or t
  misc_feature (38655065)..(38655142): n is a, c, g, or t
  misc_feature (38660474)..(38660484): n is a, c, g, or t
  misc_feature (38660750)..(38660799): n is a, c, g, or t
  misc_feature (38665545)..(38665594): n is a, c, g, or t
  misc_feature (38667234)..(38667283): n is a, c, g, or t
  misc_feature (38668161)..(38668210): n is a, c, g, or t
  misc_feature (38669148)..(38669148): n is a, c, g, or t
  misc_feature (38677900)..(38677900): n is a, c, g, or t
  misc_feature (38679419)..(38679479): n is a, c, g, or t
  misc_feature (38681828)..(38681877): n is a, c, g, or t
  misc_feature (38682125)..(38682174): n is a, c, g, or t
  misc_feature (38685852)..(38685852): n is a, c, g, or t
  misc_feature (38687467)..(38687516): n is a, c, g, or t
  misc_feature (38693269)..(38693269): n is a, c, g, or t
  misc_feature (38694484)..(38694533): n is a, c, g, or t
  misc_feature (38697912)..(38698034): n is a, c, g, or t
  misc_feature (38698282)..(38698331): n is a, c, g, or t
  misc_feature (38701151)..(38701200): n is a, c, g, or t
  misc_feature (38701894)..(38701943): n is a, c, g, or t
  misc_feature (38703261)..(38703261): n is a, c, g, or t
  misc_feature (38736777)..(38736777): n is a, c, g, or t
  misc_feature (38851314)..(38851363): n is a, c, g, or t
  misc_feature (38890108)..(38890238): n is a, c, g, or t
  misc_feature (39254787)..(39254816): n is a, c, g, or t
  misc_feature (39444276)..(39444329): n is a, c, g, or t
  misc_feature (39676476)..(39676476): n is a, c, g, or t
  misc_feature (39677145)..(39677194): n is a, c, g, or t
  misc_feature (39677362)..(39677438): n is a, c, g, or t
  misc_feature (39681474)..(39681523): n is a, c, g, or t
  misc_feature (39822719)..(39822768): n is a, c, g, or t
  misc_feature (39824999)..(39825048): n is a, c, g, or t
  misc_feature (39826872)..(39826921): n is a, c, g, or t
  misc_feature (39827163)..(39827212): n is a, c, g, or t
  misc_feature (39831051)..(39831051): n is a, c, g, or t
  misc_feature (39832240)..(39832289): n is a, c, g, or t
  misc_feature (39834083)..(39834109): n is a, c, g, or t
  misc_feature (39971292)..(39971305): n is a, c, g, or t
  misc_feature (40092427)..(40092427): n is a, c, g, or t
  misc_feature (40095200)..(40095249): n is a, c, g, or t
  misc_feature (40107194)..(40107243): n is a, c, g, or t
  misc_feature (40107444)..(40107493): n is a, c, g, or t
  misc_feature (40107669)..(40107742): n is a, c, g, or t
  misc_feature (40117305)..(40117354): n is a, c, g, or t
  misc_feature (40167883)..(40167932): n is a, c, g, or t
  misc_feature (40173032)..(40173098): n is a, c, g, or t
  misc_feature (40186958)..(40186958): n is a, c, g, or t
  misc_feature (40188259)..(40188343): n is a, c, g, or t
  misc_feature (40188898)..(40188898): n is a, c, g, or t
  misc_feature (40190838)..(40190887): n is a, c, g, or t
  misc_feature (40192043)..(40192175): n is a, c, g, or t
  misc_feature (40193315)..(40193436): n is a, c, g, or t
  misc_feature (40195101)..(40195150): n is a, c, g, or t
  misc_feature (40195666)..(40195666): n is a, c, g, or t
  misc_feature (40200436)..(40200485): n is a, c, g, or t
  misc_feature (40205843)..(40205949): n is a, c, g, or t
  misc_feature (40209239)..(40209288): n is a, c, g, or t
  misc_feature (40212281)..(40212330): n is a, c, g, or t
  misc_feature (40225194)..(40225266): n is a, c, g, or t
  misc_feature (40306122)..(40306122): n is a, c, g, or t
  misc_feature (40439772)..(40439781): n is a, c, g, or t
  misc_feature (40514426)..(40514426): n is a, c, g, or t
  misc_feature (40534179)..(40534179): n is a, c, g, or t
  misc_feature (40827116)..(40827122): n is a, c, g, or t
  misc_feature (41012956)..(41012978): n is a, c, g, or t
  misc_feature (41154300)..(41154378): n is a, c, g, or t
  misc_feature (41154742)..(41154802): n is a, c, g, or t
  misc_feature (41155184)..(41155184): n is a, c, g, or t
  misc_feature (41155841)..(41155890): n is a, c, g, or t
  misc_feature (41161447)..(41161447): n is a, c, g, or t
  misc_feature (41163272)..(41163321): n is a, c, g, or t
  misc_feature (41165298)..(41165298): n is a, c, g, or t
  misc_feature (41165889)..(41165938): n is a, c, g, or t
  misc_feature (41172868)..(41172917): n is a, c, g, or t
  misc_feature (41469804)..(41469839): n is a, c, g, or t
  misc_feature (41732215)..(41732238): n is a, c, g, or t
  misc_feature (41758104)..(41758129): n is a, c, g, or t
  misc_feature (41786408)..(41786444): n is a, c, g, or t
  misc_feature (41848850)..(41848850): n is a, c, g, or t
  misc_feature (41976278)..(41976279): n is a, c, g, or t
  misc_feature (42210646)..(42210646): n is a, c, g, or t
  misc_feature (42222626)..(42222702): n is a, c, g, or t
  misc_feature (42492030)..(42492056): n is a, c, g, or t
  misc_feature (42574328)..(42574377): n is a, c, g, or t
  misc_feature (42665615)..(42665642): n is a, c, g, or t
  misc_feature (42819870)..(42819919): n is a, c, g, or t
  misc_feature (43588027)..(43588027): n is a, c, g, or t
  misc_feature (43905407)..(43905451): n is a, c, g, or t
  misc_feature (43924156)..(43924201): n is a, c, g, or t
  misc_feature (43948775)..(43948776): n is a, c, g, or t
  misc_feature (44405473)..(44405477): n is a, c, g, or t
  misc_feature (44407747)..(44407747): n is a, c, g, or t
  misc_feature (44438968)..(44439009): n is a, c, g, or t
  misc_feature (44466594)..(44466643): n is a, c, g, or t
  misc_feature (44713020)..(44713069): n is a, c, g, or t
  misc_feature (44802298)..(44802317): n is a, c, g, or t
  misc_feature (44953503)..(44953508): n is a, c, g, or t
  misc_feature (44993807)..(44993807): n is a, c, g, or t
  misc_feature (44995204)..(44995253): n is a, c, g, or t
  misc_feature (44997599)..(44997599): n is a, c, g, or t
  misc_feature (44998048)..(44998097): n is a, c, g, or t
  misc_feature (45001484)..(45001485): n is a, c, g, or t
  misc_feature (45001696)..(45001745): n is a, c, g, or t
  misc_feature (45003611)..(45003723): n is a, c, g, or t
  misc_feature (45003958)..(45004034): n is a, c, g, or t
  misc_feature (45004235)..(45004310): n is a, c, g, or t
  misc_feature (45006490)..(45006617): n is a, c, g, or t
  misc_feature (45008960)..(45008960): n is a, c, g, or t
  misc_feature (45009556)..(45009605): n is a, c, g, or t
  misc_feature (45010364)..(45010364): n is a, c, g, or t
  misc_feature (45012412)..(45012568): n is a, c, g, or t
  misc_feature (45012760)..(45012760): n is a, c, g, or t
  misc_feature (45015280)..(45015280): n is a, c, g, or t
  misc_feature (45018426)..(45018475): n is a, c, g, or t
  misc_feature (45020610)..(45020610): n is a, c, g, or t
  misc_feature (45021151)..(45021200): n is a, c, g, or t
  misc_feature (45021904)..(45021904): n is a, c, g, or t
  misc_feature (45023526)..(45023575): n is a, c, g, or t
  misc_feature (45025962)..(45026011): n is a, c, g, or t
  misc_feature (45031355)..(45031355): n is a, c, g, or t
  misc_feature (45036400)..(45036449): n is a, c, g, or t
  misc_feature (45042668)..(45042668): n is a, c, g, or t
  misc_feature (45043390)..(45043439): n is a, c, g, or t
  misc_feature (45046380)..(45046380): n is a, c, g, or t
  misc_feature (45047287)..(45047397): n is a, c, g, or t
  misc_feature (45048349)..(45048349): n is a, c, g, or t
  misc_feature (45459192)..(45459212): n is a, c, g, or t
  misc_feature (45839539)..(45839588): n is a, c, g, or t
  misc_feature (45843322)..(45843371): n is a, c, g, or t
  misc_feature (45852797)..(45852846): n is a, c, g, or t
  misc_feature (45853342)..(45853391): n is a, c, g, or t
  misc_feature (45854153)..(45854202): n is a, c, g, or t
  misc_feature (45863782)..(45863782): n is a, c, g, or t
  misc_feature (45864935)..(45864984): n is a, c, g, or t
  misc_feature (45865419)..(45865475): n is a, c, g, or t
  misc_feature (45893898)..(45893898): n is a, c, g, or t
  misc_feature (45894181)..(45894181): n is a, c, g, or t
  misc_feature (45895651)..(45895700): n is a, c, g, or t
  misc_feature (45903358)..(45903422): n is a, c, g, or t
  misc_feature (45904527)..(45904595): n is a, c, g, or t
  misc_feature (45906343)..(45906392): n is a, c, g, or t
  misc_feature (45942729)..(45942749): n is a, c, g, or t
  misc_feature (45942963)..(45943012): n is a, c, g, or t
  misc_feature (45950194)..(45950253): n is a, c, g, or t
  misc_feature (45952668)..(45952717): n is a, c, g, or t
  misc_feature (45953793)..(45953842): n is a, c, g, or t
  misc_feature (45954394)..(45954443): n is a, c, g, or t
  misc_feature (45975235)..(45975284): n is a, c, g, or t
  misc_feature (46064441)..(46064470): n is a, c, g, or t
  misc_feature (46164142)..(46164191): n is a, c, g, or t
  misc_feature (46206307)..(46206350): n is a, c, g, or t
  misc_feature (46270819)..(46270825): n is a, c, g, or t
  misc_feature (46349417)..(46349449): n is a, c, g, or t
  misc_feature (46810131)..(46810131): n is a, c, g, or t
  misc_feature (46870351)..(46870365): n is a, c, g, or t
  misc_feature (47088491)..(47088547): n is a, c, g, or t
  misc_feature (47274352)..(47274358): n is a, c, g, or t
  misc_feature (47739671)..(47739671): n is a, c, g, or t
  misc_feature (47739813)..(47739820): n is a, c, g, or t
  misc_feature (47741602)..(47741651): n is a, c, g, or t
  misc_feature (47742268)..(47742268): n is a, c, g, or t
  misc_feature (47742978)..(47743027): n is a, c, g, or t
  misc_feature (47743359)..(47743359): n is a, c, g, or t
  misc_feature (47745303)..(47745303): n is a, c, g, or t
  misc_feature (47746110)..(47746159): n is a, c, g, or t
  misc_feature (47747348)..(47747348): n is a, c, g, or t
  misc_feature (47771074)..(47771123): n is a, c, g, or t
  misc_feature (47772648)..(47772648): n is a, c, g, or t
  misc_feature (47773230)..(47773279): n is a, c, g, or t
  misc_feature (47832771)..(47832824): n is a, c, g, or t
  misc_feature (48277959)..(48277964): n is a, c, g, or t
  misc_feature (48379729)..(48379729): n is a, c, g, or t
  misc_feature (48519961)..(48519986): n is a, c, g, or t
  misc_feature (49018644)..(49018719): n is a, c, g, or t
  misc_feature (49022583)..(49022632): n is a, c, g, or t
  misc_feature (49023004)..(49023004): n is a, c, g, or t
  misc_feature (49024298)..(49024347): n is a, c, g, or t
  misc_feature (49026263)..(49026263): n is a, c, g, or t
  misc_feature (49027237)..(49027286): n is a, c, g, or t
  misc_feature (49031950)..(49031999): n is a, c, g, or t
  misc_feature (49032680)..(49032740): n is a, c, g, or t
  misc_feature (49042513)..(49042562): n is a, c, g, or t
  misc_feature (49043681)..(49043730): n is a, c, g, or t
  misc_feature (49054240)..(49054240): n is a, c, g, or t
  misc_feature (49055612)..(49055661): n is a, c, g, or t
  misc_feature (49056189)..(49056189): n is a, c, g, or t
  misc_feature (49056826)..(49056862): n is a, c, g, or t
  misc_feature (49059649)..(49059698): n is a, c, g, or t
  misc_feature (49060445)..(49060445): n is a, c, g, or t
  misc_feature (49060910)..(49060959): n is a, c, g, or t
  misc_feature (49066625)..(49066625): n is a, c, g, or t
  misc_feature (49067076)..(49067182): n is a, c, g, or t
  misc_feature (49068845)..(49068845): n is a, c, g, or t
  misc_feature (49069439)..(49069488): n is a, c, g, or t
  misc_feature (49069805)..(49069867): n is a, c, g, or t
  misc_feature (49082350)..(49082350): n is a, c, g, or t
  misc_feature (49112235)..(49112275): n is a, c, g, or t
  misc_feature (49160059)..(49160114): n is a, c, g, or t
  misc_feature (49164763)..(49164763): n is a, c, g, or t
  misc_feature (49165598)..(49165647): n is a, c, g, or t
  misc_feature (49169139)..(49169188): n is a, c, g, or t
  misc_feature (49169759)..(49169759): n is a, c, g, or t
  misc_feature (49227942)..(49227991): n is a, c, g, or t
  misc_feature (49269945)..(49269945): n is a, c, g, or t
  misc_feature (49270444)..(49270493): n is a, c, g, or t
  misc_feature (49272725)..(49272725): n is a, c, g, or t
  misc_feature (49274554)..(49274597): n is a, c, g, or t
  misc_feature (49274821)..(49274870): n is a, c, g, or t
  misc_feature (49275050)..(49275112): n is a, c, g, or t
  misc_feature (49335825)..(49335878): n is a, c, g, or t
  misc_feature (49350789)..(49350838): n is a, c, g, or t
  misc_feature (49351870)..(49351919): n is a, c, g, or t
  misc_feature (49477263)..(49477350): n is a, c, g, or t
  misc_feature (49582389)..(49582477): n is a, c, g, or t
  misc_feature (49585387)..(49585436): n is a, c, g, or t
  misc_feature (49585718)..(49585780): n is a, c, g, or t
  misc_feature (49588477)..(49588477): n is a, c, g, or t
  misc_feature (49591175)..(49591224): n is a, c, g, or t
  misc_feature (49651732)..(49651732): n is a, c, g, or t
  misc_feature (49652510)..(49652559): n is a, c, g, or t
  misc_feature (49653503)..(49653503): n is a, c, g, or t
  misc_feature (49654762)..(49654811): n is a, c, g, or t
  misc_feature (49655699)..(49655866): n is a, c, g, or t
  misc_feature (49747479)..(49747517): n is a, c, g, or t
  misc_feature (49773855)..(49773855): n is a, c, g, or t
  misc_feature (49774858)..(49774907): n is a, c, g, or t
  misc_feature (49775853)..(49775950): n is a, c, g, or t
  misc_feature (49776598)..(49776647): n is a, c, g, or t
  misc_feature (49780046)..(49780095): n is a, c, g, or t
  misc_feature (49781207)..(49781256): n is a, c, g, or t
  misc_feature (49781861)..(49781861): n is a, c, g, or t
  misc_feature (49782379)..(49782410): n is a, c, g, or t
  misc_feature (49782862)..(49782911): n is a, c, g, or t
  misc_feature (49858641)..(49858641): n is a, c, g, or t
  misc_feature (49858765)..(49858818): n is a, c, g, or t
  misc_feature (49859413)..(49859521): n is a, c, g, or t
  misc_feature (49936613)..(49936613): n is a, c, g, or t
  misc_feature (49937039)..(49937088): n is a, c, g, or t
  misc_feature (49938961)..(49938961): n is a, c, g, or t
  misc_feature (49943573)..(49943622): n is a, c, g, or t
  misc_feature (49944115)..(49944119): n is a, c, g, or t
  misc_feature (50034623)..(50034623): n is a, c, g, or t
  misc_feature (50040203)..(50040252): n is a, c, g, or t
  misc_feature (50069405)..(50069476): n is a, c, g, or t
  misc_feature (50071549)..(50071598): n is a, c, g, or t
  misc_feature (50071902)..(50071951): n is a, c, g, or t
  misc_feature (50073367)..(50073416): n is a, c, g, or t
  misc_feature (50073850)..(50073899): n is a, c, g, or t
  misc_feature (50124976)..(50125021): n is a, c, g, or t
  misc_feature (50539322)..(50539322): n is a, c, g, or t
  misc_feature (50582103)..(50582103): n is a, c, g, or t
  misc_feature (50583244)..(50583293): n is a, c, g, or t
  misc_feature (50715009)..(50715009): n is a, c, g, or t
  misc_feature (50716453)..(50716502): n is a, c, g, or t
  misc_feature (50720248)..(50720297): n is a, c, g, or t
  misc_feature (50720534)..(50720583): n is a, c, g, or t
  misc_feature (50724649)..(50724649): n is a, c, g, or t
  misc_feature (50724861)..(50724910): n is a, c, g, or t
  misc_feature (50725148)..(50725197): n is a, c, g, or t
  misc_feature (50725489)..(50725538): n is a, c, g, or t
  misc_feature (50733279)..(50733354): n is a, c, g, or t
  misc_feature (50734615)..(50734615): n is a, c, g, or t
  misc_feature (50736472)..(50736521): n is a, c, g, or t
  misc_feature (50737311)..(50737311): n is a, c, g, or t
  misc_feature (50812346)..(50812346): n is a, c, g, or t
  misc_feature (50830373)..(50830393): n is a, c, g, or t
  misc_feature (50898094)..(50898143): n is a, c, g, or t
  misc_feature (51254055)..(51254077): n is a, c, g, or t
  misc_feature (51538920)..(51538920): n is a, c, g, or t
  misc_feature (51541062)..(51541111): n is a, c, g, or t
  misc_feature (51541671)..(51541671): n is a, c, g, or t
  misc_feature (51542933)..(51542974): n is a, c, g, or t
  misc_feature (51552683)..(51552732): n is a, c, g, or t
  misc_feature (51553431)..(51553431): n is a, c, g, or t
  misc_feature (51557158)..(51557207): n is a, c, g, or t
  misc_feature (51561355)..(51561407): n is a, c, g, or t
  misc_feature (51562169)..(51562218): n is a, c, g, or t
  misc_feature (51568660)..(51568709): n is a, c, g, or t
  misc_feature (51569306)..(51569355): n is a, c, g, or t
  misc_feature (51579936)..(51580006): n is a, c, g, or t
  misc_feature (51580272)..(51580321): n is a, c, g, or t
  misc_feature (51582337)..(51582337): n is a, c, g, or t
  misc_feature (51583963)..(51584012): n is a, c, g, or t
  misc_feature (51585082)..(51585082): n is a, c, g, or t
  misc_feature (51807487)..(51807536): n is a, c, g, or t
  misc_feature (51912534)..(51912534): n is a, c, g, or t
  misc_feature (51913338)..(51913387): n is a, c, g, or t
  misc_feature (51915209)..(51915233): n is a, c, g, or t
  misc_feature (51915956)..(51916017): n is a, c, g, or t
  misc_feature (52212948)..(52212984): n is a, c, g, or t
  misc_feature (52709298)..(52709312): n is a, c, g, or t
  misc_feature (52792213)..(52792223): n is a, c, g, or t
  misc_feature (53087620)..(53087669): n is a, c, g, or t
  misc_feature (53221258)..(53221282): n is a, c, g, or t
  misc_feature (53325381)..(53325394): n is a, c, g, or t
  misc_feature (53337236)..(53337236): n is a, c, g, or t
  misc_feature (53362556)..(53362556): n is a, c, g, or t
  misc_feature (53401113)..(53401121): n is a, c, g, or t
  misc_feature (53401437)..(53401437): n is a, c, g, or t
  misc_feature (53401856)..(53401905): n is a, c, g, or t
  misc_feature (53404214)..(53404271): n is a, c, g, or t
  misc_feature (53405377)..(53405426): n is a, c, g, or t
  misc_feature (53409753)..(53409802): n is a, c, g, or t
  misc_feature (53505225)..(53505240): n is a, c, g, or t
  misc_feature (54037282)..(54037282): n is a, c, g, or t
  misc_feature (54232621)..(54232621): n is a, c, g, or t
  misc_feature (54233330)..(54233379): n is a, c, g, or t
  misc_feature (54258050)..(54258050): n is a, c, g, or t
  misc_feature (54258776)..(54258825): n is a, c, g, or t
  misc_feature (54261083)..(54261083): n is a, c, g, or t
  misc_feature (54263268)..(54263317): n is a, c, g, or t
  misc_feature (54264298)..(54264298): n is a, c, g, or t
  misc_feature (54265937)..(54265986): n is a, c, g, or t
  misc_feature (54272082)..(54272131): n is a, c, g, or t
  misc_feature (54293792)..(54293841): n is a, c, g, or t
  misc_feature (54322026)..(54322075): n is a, c, g, or t
  misc_feature (54322857)..(54322857): n is a, c, g, or t
  misc_feature (54325946)..(54325995): n is a, c, g, or t
  misc_feature (54446066)..(54446115): n is a, c, g, or t
  misc_feature (54831911)..(54831923): n is a, c, g, or t
  misc_feature (54887052)..(54887052): n is a, c, g, or t
  misc_feature (54890931)..(54890980): n is a, c, g, or t
  misc_feature (55041242)..(55041248): n is a, c, g, or t
  misc_feature (55109601)..(55109605): n is a, c, g, or t
  misc_feature (55329262)..(55329265): n is a, c, g, or t
  misc_feature (55665087)..(55665087): n is a, c, g, or t
  misc_feature (55665835)..(55665915): n is a, c, g, or t
  misc_feature (55674773)..(55674832): n is a, c, g, or t
  misc_feature (55676635)..(55676684): n is a, c, g, or t
  misc_feature (55678418)..(55678506): n is a, c, g, or t
  misc_feature (55680546)..(55680546): n is a, c, g, or t
  misc_feature (55708304)..(55708353): n is a, c, g, or t
  misc_feature (55759721)..(55759721): n is a, c, g, or t
  misc_feature (55760712)..(55760761): n is a, c, g, or t
  misc_feature (55762547)..(55762704): n is a, c, g, or t
  misc_feature (55770433)..(55770433): n is a, c, g, or t
  misc_feature (55773499)..(55773591): n is a, c, g, or t
  misc_feature (55773944)..(55774001): n is a, c, g, or t
  misc_feature (55775053)..(55775109): n is a, c, g, or t
  misc_feature (55775544)..(55775624): n is a, c, g, or t
  misc_feature (55776101)..(55776101): n is a, c, g, or t
  misc_feature (55777479)..(55777528): n is a, c, g, or t
  misc_feature (55778895)..(55778895): n is a, c, g, or t
  misc_feature (55786835)..(55786884): n is a, c, g, or t
  misc_feature (55791688)..(55791737): n is a, c, g, or t
  misc_feature (55791889)..(55791905): n is a, c, g, or t
  misc_feature (55792984)..(55793033): n is a, c, g, or t
  misc_feature (55793462)..(55793511): n is a, c, g, or t
  misc_feature (55796672)..(55796721): n is a, c, g, or t
  misc_feature (55798750)..(55798750): n is a, c, g, or t
  misc_feature (55798998)..(55799008): n is a, c, g, or t
  misc_feature (55800871)..(55800920): n is a, c, g, or t
  misc_feature (55811009)..(55811178): n is a, c, g, or t
  misc_feature (55812046)..(55812144): n is a, c, g, or t
  misc_feature (55893847)..(55893896): n is a, c, g, or t
  misc_feature (55895935)..(55895984): n is a, c, g, or t
  misc_feature (55896483)..(55896558): n is a, c, g, or t
  misc_feature (55896699)..(55896699): n is a, c, g, or t
  misc_feature (55897586)..(55897635): n is a, c, g, or t
  misc_feature (55907093)..(55907245): n is a, c, g, or t
  misc_feature (55908318)..(55908398): n is a, c, g, or t
  misc_feature (55922798)..(55922850): n is a, c, g, or t
  misc_feature (55963935)..(55963984): n is a, c, g, or t
  misc_feature (56252532)..(56252581): n is a, c, g, or t
  misc_feature (56512994)..(56513088): n is a, c, g, or t
  misc_feature (56528082)..(56528082): n is a, c, g, or t
  misc_feature (56537988)..(56537988): n is a, c, g, or t
  misc_feature (56742638)..(56742687): n is a, c, g, or t
gcggagttgcactcgtttggtcaatcatgtatatttctcaacgaattattctgacggaagaaagcttgcgagaaacggaagggaacaataattcaaacattaggtttgtgttcataaaccgttcccttttccccctacccaggagaacaggcatatagctgcagcagggttagataagtccagaacggacaatcggagtaccgggcattcagggattttattttcattgggggtactccagcttcaaatctataagcaggtcgatttcggtcttttctgacttttgtctccggccggaacgtccgggggatgactggcaacgcttacttcccgatatcaacctccgaagcgtcggccgagtcatctaaccgagacgcgcgaggtgtccaatgcacgggtatccccttgttgatcaatttaaattactctctgaagaaaacgaatacgtcattcggctcgggtcacattgactcattaggatctacaagcagatagacgggggtaatgtgtctggtgatgcgcgttattctcctcagccctatcaccgaacacggtcccccccgacaccgcttaagaggtggacaagcttgatccgacaaaggaaccaaagcgggtcttcttgacaaatcctttcattttcggtgatgagatgatgtgatctcgcagtcattttcgagcaaactttgtgacacgttcccaccgtgcatgccggagactgcggagatggcacgaataagcgggcacctctcggctgcaacggaaatcaaacggccaactatcgtgtgatcatcccacattccttgctccggatttctcagcagccagtcacgccgaaaaggaggtgagtacacataattgcaaggatatgaatactcaagaatttgcccatttgtaaaatttggggttggtattcgaccaaaacactcagcctactcgggtttatgatcgtttatttcgttccatcatgtccgtggccgttacacaccctgcagctgtcgctgcccccatggacagccaaacaactcctataagtggaagctcgcggtccagcgaaagtgtcgatgagaagcctaccaaaaacgtaggccgggagccagcaaaacaacgcgatgtggaccggtctgcctcgactaaacgctggaagacatttgtcaggtctttcaagcacatatacaatcttacaccaaaagaagttgaggattttatgagatcatatagaatatatgacaacgattgggcggatgaggagaagatgattgcagcttttggccctgattatcaacagcaagttggcgactctctcaaagcatattactcggttctgaaccatctctgtagcctgggcgatgtcgagaaaatgtacattccgcctgttatggacaagaaagcatccgtcctcgataaccagctgttgaatgaggaggcaatagcagaagagattgggttgacgccctcaatgaaggtgctggatctgggctgtggccgaggaagagtggcggcacacatgagcagctactcaggggccgaggtcactggactcaacatcgacgagaaccagattaaccaggcgcgacaatggaatacggcccttggcaacatgaacaagttcgtggtccacgatcagaatgatctacccctgccttttgaggaccaatctttcgatgcattctacgagattcaagcgcttagtttgtgcaaagacccctcactcttattcaaggagatacacagaattctcaagcccggcgccaaatttcttctcttggactgggtaagcttgcccgcctacgaccccgagaacccgacccatgcaagcttaatgcgccgggtgaaacccctgattggcgccgtaggtacaccgacaccggccagcttcgagaaggcattggtagaagcagggttcaccatcataaaatcagacaatccgagtatagacggccgccaagccgctctcattgacaaggtcgacttgtatttccgttctctgagacggatgattcacggattggttcatgcgcatctcctaccgcctcacttcactatgctcatcgatcgtttttgccttgatggaaaggcgtttgagcagatggacgacatgggactcgttacgactacgtatagaattgttgcccaaaagacatgacctcttggcttgtttgccccttttattgtaacaaaagactgtttttccctttgtttaagtggaagttctattctaaatttggatgtgatataaggatatggtatgaccactacagagcagttttacaaatagatagagcgggatctctttttttcttttcagttgtttgaggtgttagagaatacttagacttattcaagatgcttttatattttgaggaagagattctgaatgtgtgttgagagacagcaatagtaatttaaaaagaaactcatccttgagaaagttcgaagataggtatccaacctcagagtgagcgtttttagactatggtaacggcattgactatcagccctcacgtaggccttaggggtatgtaaacccatcattcttttattggctccaatgtatactttttactcttttcgtctgtcgcgttgaagattacgtggagccattctattgacatttaatgtcgatttcgtgtgcaaattttgctaatcaataaacgttcatccaatatacaatgtgctttcaagatatttgcccgctcaagatcaattcaagggccagccagaagaaggggaaattctcgatatctctccagttcttatttgaaataataacccttgtactcatttgcgggctgggagggctggggagctttcgacgttgtgtataggcggtccatcccattcccctcctccttatcacggcgtttgtcgcgacaccgtttgatcatcaagccgacgcctactaacacggctattgccgcaggaacaccaactcccacgcctattttacccgcaatgcttagaccgccgctatcgtcatcattgtctgagcccctgcctgccagtgttgttggattatcgattgatggtgtttctatacgtggaataggtggaaggtatgctgccaggcagccttgtagtaggcagagaagaagatataaagatatcagtgactccatcgcgatgttatgcggcatgttgaatagatgtgtggttgtttactgttgcgaataattttgctggtcttcagtaatggaagagatttttgtaaccatgtaaaataggaggaagaagtgaatgatcggaaatctgtaccacgactaactcagcatgaaatacgtcccattttctattgaagagaagatcctgaccgggaacacggcgaggagcacatcgaatactattaaccgctgtctccacttacatgcagccatcattctggacactccaatcagcttggaggcgctgcagccaagccggtccaggccttgttgccgttgttccgacttgcaccagctggtgatcgcgtataacctcaagtttccagatgccctgccccccacctcgctatcatcatcaatatgaactcgattttagagtgttatgtatacctttagtaaacaaaaacctctccacaacccagctgacgcatcaaactcaccgcgttggtagaacgggcttcgagtgtatgaacagccggaaatgtgtagcggatataaggctggccgatctgccgattaagcgcccaactttccactaccgagtgctaagatccgtctttgggctctgatagggcatttgatgcccctcaaattcagggatcacattgcatttctgtctctcatacgcctgagcctattggacttcagtccagatgctggagtccatgtgccattttcccttcgagcttgatgacgcgtcctcagctatcacctgcgtacctcacgccatgtcgtgcctcttcaaagccgccctataattagattgtctttccatatatgtactcagatttcagccagtagggggtttaataatcacccgaagcccttcgtattggagagaaaggcaaggtcttctatatgatcttaccattgtggaaataatgtcaatctctcgatagcataatgttcttttctaacttggaccttggataagtgatacagaaccgcaagtcagggagtaccacatccttaatctgtacagatcatcgtgtctactggttcctactatgtgctctgcactttaggcgagcgtgccgtcttttgggtaactttcgtatcaatgaagaagcttcccacgttcgcgtggcctaccatcggaaattcatgaccccgatagtacacatttacctaatcattgcgaggcaaaagggtgacatttggaagccctcggtcaacgtcaagtgttccgtcatgcaataaaaaggatcaggcgagaatgtcctgaggttagtgcttcaggccacactgtccagtcacagcccataattggggttgaatcaattcacacaaaggatcgcggtctaaaagagaaatactgaaaaccatcagcggataagctacacagaactgcacaagtagatagagagtagaaagataccgttacatctagcttagccgagcagctattgaaacacattctacattaacaagagattccagttcctaagctgcaaacaacctcgtggtgactatggaaccgtcgcccagacaagtacatcctgccctcctggtcatcaaaaacgaaaccaaatccggcgcaccctgtcctgaagaccggccatcacatttgtacctgtccagttggtaagtcggtgacgtaccagttactcccagctacggttcaggctttcaccatactgaatgaacttcccttgcctctagctcgatattgctagtaggcccatccatcgagaacagaaaagattcaatagcggcgtcactcgggaagatctgagcagtgatagagacttcaccctgcccaccaaacacctcgacggaagaccagtcgctgaggaccctaatcgtgacggtgccgtttctagagggcaacggcgcagaatacactcccggaaatgatccatcgaagtcggccacgcctgacagtgtccggttgacaaagagctgctccgttgtgaaatcgtacccgatacgggtttgctcactaagatccgccgtagcctggacgataatgccaaaataagtcgactctgatttggtaaatgttagcgtagtgtcgagtgcctttcccgtaaggttgagtttagtaacgccagctggcacagagtcccaatgctgagtaaagcctgcttcctcgtccagaaccggactctgcacgagagttaccgtattgtcaatagtctcaagcgaaagttttcgggggatgctcattgcgctccgccaaggatcagttggtatcaccccgccatacttccagttgttcatccatgcaatatcaacccgctcagtatcaggaagacccgaaaagctaagagctgcgtagaagtcagggccccaatcgagccagtttgtctgctgcaggctctcaggatccgcggtgaaggttgttccatcgaagtctccaacgaagtattgagtccccgatccaggtgtacctggcgggcctcctgggttgagcccgacctgcgcaacccatttcacaccgccatccccatcaacagggagagggaataaacttgggcattcccacacaccgccaacggcattttctggtccgaattcgctggcaagctcccactccttaagatcgtcagatgtgtaaataaggagcttgtgtagttgggccaaggagatgactgaaacccatttactactagcagcgtgccagaagacaccaggatcgcgaaactcgcggatctggtcggcgtactctggaggaggactgagcagcacaggattaccctcatcataggtggtccaagtgaaaccatcatcaaggctgtaggcgatagactgtgactgctgatttacttctaccgacttcccactaggtagtgtctgtgcttgagggtactgaaggcgaagattggtcagatacttggttgttccgctagaaataatggaacacttacatatgatgtatacattgcaactagaggagccttatcaccagcaccaaagccgctcgtgttattgacgtctgccacagcagtaccagaaaagaacatctctgtgatattatctgggaagccacgagcttggagtgcgactggttggtgctcccagtgagctaagtcggagctagttgcgtggccccaggacatggctccccatgttgtgccgcctggattatactgatagaacaaatggtagatgccgtcgtgaaagatcaagccatttggatcattcatccagtttttggctggagtgtaatgatattgagggcgatactgctccttataatcctgggcagacaccatctgcagcagaaagaggcccagaacttgggcagcgcgaaggcaggcagtcatgatggtaaaagcgatgggtgagacgaagtgtgaatctgactgtgctggtcctcttcttttcggagaacacaattttcaggccatatatatatatttccggtgttagtctgttttgtcgtatttcccatccgtgcttctgtagaactgtttgatgcgtgtgtgtgttgtgtccaaacagtggagattgcgagtctagagtcgggatttccctttaatggaaggagaatggtcatggcttgagagaccttggctgccgatcactgagttatcctgctttcaaccctggagttactgtagatgacggaggcggtgttacacgacatctcagccactagtgaacgcaattccctactttagcaatatgtccgccgagcatgcagcccgtcatgattccgtttcgacacctgggagcttaggacacagatgtatgtgtgatgacatgccacatgctcttccatcctgcatcccagtccggggtctgtggaggcagcgtggtttcccgcttcaggcaatttccgcccccacaaacgtgtaccccatattgtttccccgcgcttccacctgtaacctaaagttcttcagcaagggtactaagatcaggatagttctggagcacataataggggttgttggatgatggccttgaacctctattaacagcgtaaaaaagagagcgagatgaaattaaggggcaagaaaggaggagtgaatggttcgatcttcacagatggacgtgtttttagccaatatgaaataatggtaaacgatgatcctgatgcttgttggtcttaaattggttcatgatattttgagctttacccaaaatagtaaaagcaacgaatcaccgccccattcctccgccaacactttgttcagagttcgatatttacggtaatacgcgaccagtcccttcccacttctactaaccctccaagcccaagtcatctggtagcagcctaagatttataagcaggagtgatgttatttccacaaatcttgcggggtagatgcgtgattttgtgtttaaactagcctgacatgaaaataaagtagcggcatacgatatgctagacgggatttcccgtttatggaaggagaatgacgatggtagtctgacgggaacgacaacttgggaagaatgacataacctcggggaaaatctgtgcccgaatcacttcaaatataaagaaggctctggttacgttgagccaagtcaacgcccctaaccgagtctaccatgagcctcttgaagcttctcgaatgtctggtcgatggtgagtttggtctttaaggagatttcttcgatctcctctaccgtacttgtatacgctggtgcgagaagaacgtggtctcctttcacaccatcctgagttccggtgccagggtataagcttattccttggtctttgagcccgactgtatgaacaagattggcaacagcaaatgaaggcgggaatgggtcttttgtctgcttatcagcaacaaactcgatctttgactctggtcagcatgtctttttaacaacttgaccgaggtcagatagcttactccccaaaatagcccccttcctcgaatattgccaacataaggatggccgtcgaggtatttgtgcaaaagcgaactcaaaagctttccacgctccttcacgtttgtgaggagatcatcctctctaataatgcgctggacctcgagcgcggcagcgcaactcacgggatgcccctgatatgtatggccatgtgaaaacgctctgattgagatattagcgctgcatgaatattcactgggcctacttacccagtcccgttctttagcgcatcagccactcggtggttgattaacattcctgcaacaggagcgtatcctcctcccaaccctttagcaagggtctgaatgtcgggaacaacaccttcctgctgccaggcatggagtgtcccggttcgacccatgccagacatgacttctgtaaactagttaacgcaagagcttctacaaaaagaagggtctccctgtgagagagtgcagaaagcataccatctaggatcagaagagcgccgtacttgtcgcagacacccttcatggccttaaaatacccttccacggagggaacacacccaagagccttagaatatcgtgttagaatagaaaatgtggctctatcgtggggaaacatactgctccaacaaccggctccgcgacgaatgcgcaaactgtctcgggaccaagctcctgaaactttcgatccaattcgtccgctagctgcgcaacatattcctcggttgtttgtccctcacccattccgcggtaggcgttacaagctgagacacggtggacattagggagaagcatgtccaaaaagaggctgcggcgagcaacgtggccgctcatagataagccgccgattgttgttccatggtaagagccttctctggcaatgaagttgatccgtttgttctcctgtgggcttaattccgtgaaatactgccgcgccatcttcatcgccgagtccatagcctcagatcctatcatcggcaagcatcccgttagtgtatgatcaacgcatcaagccagcatcgggtgcttacctgaacacatgatgtaagccttggccatggctcctccagttccccggatcaattctacgcacagctgctcgcctattggatgcccaaagaacatagaattgcagtacgaaaacttgtcaatctgctcaatcatggccttcttcactcggtcattatggctgcctatacatgccacggcagctccacaggtcgagtcaagtatctcatggccatcggaaaaggtaaggtgtctctctctagcagagacaaccagcatcggcggggttttcagggaccggtgcagaacagcactatcttgttctgccgtcgaactagcagttgctgcaatggaagcaaatattcgttgctggcgaggcatcatgaataccggactaagcgaggtagaacacaatatcttggtccccgacgtagccctgaagggccctagagctaccttttgggcaatcatcttggcttggaggaagcggtctctgaactgatgcaggtgacgtgatgctgatcgcgagtttgtcgcttgttccagcgagacggcaagataaagcgacccgataatgccacgtttgtgatcgggaggactcaaagattgtcttgtcaattcagatatcactcgttgcaattgtcgtagctcaggagcatgaagattaggagataggcattccacgatcggtggatgtcttgagcgtgttgggcgtatcgcgggcgcctgaccaggctgataccccgccatctctcgttcacacatccaattgtttacgagaaatcctgcattccctagataatgctacgccaagtcgagttagcattgtctcctcccgtctctaacttgcatacaactgcggggtggtggctgggcatctagataaggggccggctagcatcggatactctgccccgatctcggtgcctatgctagtgtgatgcatcttgaagtcacgctcctgttcaagtttctatcatctcaacccattgccattgaagggcctttttcttcctctgcaagctggaccactcaagtctccctcggcgccctcttctcgatgccctactagattctattccgtgaattttcatcagaacaatatatttacagctatgcctgcttcatcgtcttctgcttcttcgcagtttcggcccagtatgccaactctgcctcgagccagcagacgtggaatgttgaaccttctgcaggcttgaccaacatatttactggaagttctttgatcaaagagccagaaaattgtaaacggctgtactacagcggtccaaactagcccaaactacaatatcttgcgatcctaaacattatgatctgtcctatccgtgtaacgggcagtgatagccacagcactcaacgcaccagcaaagctgccgccttgaataataataacagtgagtagaatgacagtggacacatcggcaaaagttctgagtctgataaaggttcacgtttcatgttagagttcacacaaacctctagaaatcctcccttgggcacctctaagacttatggaagtccacacgtactcaacgctctccccgcaccaacacttctagtcgacttcactcccttctgggactagaggcgcctcagcttccccagaatctcatcccgcaggagtgtcccgatctgccgcgataactaagccatcatttagtatttcctatgtcattctaaccctgctttagcaccaatcctgccttacaggacaagggtaagcattcaagacattgtaggcgcgaaggccattcaggcggtaagcgttctaactggttgttccatgagtagctctggggccttcaaaggctacgtccgatctcaagatagtggttcaggccctgattcctcctcggcaaggatctttccctctcgaaaacttccaattattacattcgtagatacaacagtagtgatttccggcgcccatttttaagccttgaatgtcattgttcatcgcgtgaataatttcccgagcaatacttctcagatgggttgatctggttcagcttgcaggatccggccaacaagccaaagaaaaggacatatatatgagcaatcaggcaatatcgcaagaagatacaataccccgatcctttatatctgaggccattctcaataagaaaaagacaccctcctgagaactcacatatcacacccttgatgtcacccccctcttttcgccctttcaccctgcctccaacttgcagatttagtcggttccactcggttacgccaacccgaaagagggaatgatggtgagagccaccagtagtcaagtcttgggagagcccgcccatcaatgcagaatggccatgcctatccgatcctatccttgataggtcatccgattagacattgcctgtcctgatagctctggcaagatcctttgtcgggatcgccttccgatgccaatggatatggcttggcgcccaccaagccgtatcagctgattcacttgactccttgctatggataactccctatccggggacgctttttaagctttctttctcctcgctaccgaatgctccatagaggccactcagcggtgtgcctaccccaaatcccatcttggtaatattgatgagcgccatgagagcatcctccggctcatacccggaatcggggccgcgagtgtcggagcatggccattatttagagtagatcaatcaacgtttgcttccccttcctcgattgcccttccatgttgtgttccctctatttatcatttcgcctcatttttcactgaagtgctacaacatgttggaccttatcgtcatcggtgccggcttcagcggcctgcaggccgcctactcagcccaacaagccggtttgtcagtcgtcgtcgtcgaagctcgtgatcgggtcggcggcaagtcatggagcgtgccattggcctcaaaccgaggaaccgctgatctcggcgctgcctgggtcaatccttccaagcagcctcgcatctggggctacgcgaagcaatttggcatggacaaaaacaacacggtccaacgactcactgggaaggctgtcatgaacgtaaagcccggcgagagaattgtgtacccatttggtatcactccagaggtaagtagatcgatgcatgttttatgcagtggtttccatctacccgtaccgctgctgacaattttgatgtacgtcgtaaagttcgcacccgaggtcaagaagaatctcgagtacatccgtgaccatgtgcaggcagagtccctcaagcccgggcctcccaaggtcgaggacgacaacgtgtccatggaccaatatgtgcgcggacttggcgctctgcccgagacttgtaaaatggtcaatgtatggacgaaggccatgcatggtgtcgagtctcatgaagagtctgcagcgtattttatcgactactgccgcaaaaacaccggcctcttgtcagtccgaggagatgatgatcaggggggtaattatatgcgactgcacgcaggtacgactggataatgcacagttcagccctcaaacacacagtctaagcagctccagctaaccgttcttcctcgtgcaggtactcagagcattgccaaaggtattgcgcgactgattggcgctcacaacatcctactcagcaatcccgtcgcttcaatagagaacctcgacagccacgtaaacgtgtataccacgaccgggaaaaccctacgtgcacgtaaatgcataatctctctccccagcaccatgtggaaggagctcaccttcaacccaccccttcctcaggagctcaagacgatctctgacaacaccaggctgggcaactacaacaaagtcatagtcgcttgggacaaaccctggtggagggatctcggcttcaacggattctttatgagtttcgagggaggccctatagcgcttggccgcgacacgagcgttgaggagaaaaacctgtacgcattcactctgtttgtccaaggtgacgcaggatatgagtggtcgcaaaagcccgcccacgagagacgagctattattcttgaccagcttgcttctatctttgatgtagggtatgattctgagctctacaagcctatcgagatcttcgagatggtctggaaaggggagactttcagccgaggagccttggttcccatcaccaaaattggtgacttcacaaagtacgcttcagtgtatggtaagcccactggcaacctgcattttgttggcacagagtttgcccctgtctggaagggttacctagaaggagctttggcgtcaggtgaagttggcgccaaggaagttgcggaggctatcagcagcagtcctatcgccaaactgtaaaatgttgcgcgatttgaacttatgatgacatacgaggacaagtgtacgtcggggtcaggacttctagtggctgtgaagggaattctggacttatagccgcttgggtctttttttttcagcatagcagtttgcatttgaaacacggatggaaagataacatgctagtcaacgcatttaatataaaaataaatgttgagataacagtactccacacacatcgatctggtgaccctgttttcaaaagtcaccattgcggcgcaatctctagctcatgaatcatattcgcccacagctcgccctccaaaccagggcgtgcagcggggtccaactcctggaaccatcgacgaacagcctcgtaatcccttcgactacgatctcgagaccaccacaaccccttgaagcgacacatgagtccgcaccagtatccatacagccatgtggccttctcgttctgctggtgaagcaattcccgaaagtgcgggtgcgctttggccaagaacgcgaaatggtggaacgagttggtaggcaagggttcaacctgacgaaggaaagccaccaacatcataggagctccgagaacttcactcatcggcaggtgagacaccacaactttagaactctcggagttgttcccgggggcgcaggtgttgggtgaaacagctgcagtgcccaaatcgaagaaatttatccaaacctcggggacgcctcgcaacccttgagacatagccacatgacggctttcatttacccctaagaagatgggtccaaggagttccatagctccttgaaggcggtgtccaccggatttgaggagtggtctgagaccagactgcagagctagccagcccagtgcctcagttgaaatgtttacccaacaatcctctgttgggcttctatctgtattataaggagcccttgggggcaatggaaagcagagaatattcagcagcattccgcctaaaactagctcgttaaattctgcttcgctcatctttgaaacggacacagtaagtctgctgagatactcctgcactgccaacgactcgtagaaatgttcggcgatctggtgacgcagattgttcccagaaaggtgtcgaaggtggcatgctgtgataccgataacgacattgcggatcagatggctggattgaaacatgaatttgaagacatcagtgaactccacgtgcaggatatttccccaacggctctcacaatactgcatgagttccaacatcggagtgccattcttggcgttcagcaaaggaaatggagaaggcacatttaaggtataaagagacggagagaagccgctagtaagaatcccaattcctgctctggatctcgcgatcagttggtttgacggggcagtttcgccttcgctgtagtggcactgccgtccatttctcacgcaccgggcacaaaccggtctcttctcatcgcacttgacggcaattagtctcataaactgcggaacaaatcggtggcaggatgaacaacctttactttcttggacttgcaggtggagcagccagacttggttttggggaatactttgcgctttcgataaccgggaatacgggcatcccagtcagtcgcgagcacgacatgaaattgatccgccatgcttgctgttagttgtaagcttgcaaaaccaggcgtagctcaaagcagtaaccgagcgtggagagtgtcggcgtctttatgctttcgttacgtccgtcatctccgtgatcttgatgacgggatgacgggtgcaaggggtgagtggaaacagctcggttacttattgtagattagcttctctccagctcggttactcttcctggcctagtctcaatgataggcgaaggtgtcaggtacgtctacaaaagaatgcgaatataaaggggatgtaaatccttttggagtccatatttttcttgagacacgcttcagtagcaaccttgtatatctatacctcctttttcactctgaaaatatgcccagctcgtgcaaaaacaccacgaaacaagatgccaaaccgctcaaggcatcgaaggacatggagccctgggagaaattctggggcccagtcttctatcagaatcagttcaaaaccacgctcgaggtgccctccaaagggtcatggcctgatgtaaccggcaagtgcgccatagtcacagggtcaaactcaggactaggcttggagtcttcaaagcaactcctctccctcggattgtcacatctagtgatggctgtacggtcactcgaacgcggccgagctgccgccgccaaccttattgagcaaaatccttccgcaaaaatcgatgtttggcagctcgacatggagtcatacgattctattcgggccttcgttcgtaaatgccaacatgagctctcgcgcatcgattttgtgattctgaacgccggagcttcacctgtccgcttcgccaaagtccccgctacgggccatgagagaaccattcagcttaaccacatcagcaccgctcttttggcagtccttcttcttcctgtcttgaagagcaagaccgcaggtcctgacccacctgttatgaccgctgtcagctcagtcatggctcacttgacgagtttcacaaacagggaccagcggccgctgctaccatcctttgacgacacatccatcacgccttttagtcccccagacaggtacggtgtatcgaagctactttgtcagctattctttgtgagactcgctgaaaaggtggaccgtaacaccgtcaccatcaatctcgttgagccaggcctcatcaaggggactggcctgtcgcgcgaagcaacagggctggctggggtcttctccaacatcttccacggaattgccggtaggcctctagagcaaggcgccgcaacatatcttgatgcaatactcaggcatggcaaggaatctcatggctcttatattatgaatttcaaattcgcgccgtaagtccatgacccccttcaatcccggaagtcattatatcatataacttactttcttatcaggctagccaaatggtattattcggatggaaaagctttggctgatgtcatctggaccgaaacacttcaggagctttcttcagtcaatctcaacgacatcatcgcctctctctaacctccccttctgtccaagcaaatccctagatcctagtcttattgtcgatgaagacatgttaggcaagggttcagaacttctaaaagaagttggggactttcctcttagcaaatagttgtcatcagtctagtcaatctacagtttgtcattggtgcccgatatatcaccatgatacagcaatctcgagtacctagtagtatacatacttttctctttctatccgtccaattaaattcaatgcattgataaaccataatcaaccaaaaggaattccctacaccaagtacgataacccaacatctcaacctcggagccagtgctttcaaaacgcctggcacttcagccaatagtgattgcgccgtctaaataataaacctggccctgtccaccacgcatgatgagcatcaatggatataaagaatgagactccccagcatctaggttcggtttatagtcttggattatgtgacaaaccctggcttccttctggggccactcattccatctgcctgtctccatcggtgtctcaagcccatgccaggcaatatcgtgctcgatttctatgacgcgcttgcaaatcgagcacatcttgtctgtctcccagagtccttgcctcgcggaaccgtattgcctgagcaatgagtaggcttgaagcctagtggggagatgtcggcatttaagaatgacagctagtatattcgtgagatatcctgtctcgagctggaacacgggccggtctggggagccaccattgcgccgaatcatggatgcaccgatctcctccatgtgtgcaactatatgccgatagtaagggagaagttggtcaaatcgcagttcggaggtctcgaatgccgtcatcagcccgatttggcacaggtccagagttacgagactgccgaggtacattaatctgtgatcgtcggattgtgagctatgagttcccaacggaacaaccgtatctcgaaatctatgagtcacgcgttgaagctcgtgttgttttgcggtcaggactgcgtgaactggttgatgtcgcagccttccgtgacgatactctgctccatcagctgcgagttggaatatctgaagatacagttcgtcggtcatcactctcgcatcctccaaggttgaaaagtctctatcgacatggagtggtcgagctaatgcatctacctcatcgcgacgaccaaatttcaggagcaggatcgactgtcgctgatagagcggcagcagtgtgtctcgcacccacggacggagtcctggtgttgctcgtatgatgcggagtccagcttcgaggtggcccagggccttgctttcgctcccttgcatcagctcgatgcatataaacagcaggcatgctaacaggatcagatgggtgtccgtgaggtctttgagctcatgtatggctgcattgtagtgccgaagtgctgtcatattgtgccgtagttgaggcattagtctaccattacctatgaagtcttcatacagcaaactgattgcgacaacactgtgccggatagctggttcatgagtcccaatctgcagaagggtgtgagtccagaaggaggatgggtatgggccggacagccacggcgcgacgccgagctggaagaaatgaagagcacgagcctcctcagtgtgacaagagccccagctaggagatggcacagtagctgtcgttgatgctttgtacgttttccagtggaatacaggagagaagccgtcacattttcgtcctgtgctggtgcagcgcttgcactcaggtcgagcctcatcacactggtatgcccagagttagatggtgcctacatgaaagtaccccacgtgcgtaccttgatcttccttatcctagatatacatcagcacgattggtaccgtatttcgccataagtgtaagcatacttgcatgtgtggcaccccgtgcgaaccctcttgatacctccttggggcatgctgcactcatgtggaagtccaggagacaggatcccgggcacctcggtgcagctcacctactaaattgcttcggtgtagacaagcatcaggcaaagaatctattcacaacttttatgtctcaaactttagatcctgctcatgccgctcatgttgcgtgacgggaaaggaagaacgactccttgtggccggtgatttgtaaacatgcgaagtggatcgacaggctaagctcgagacagaatggccaattattaatcatcagtgattgcccaagccctgccattaaaaaaattcagggaaggccaacttcctcaacgagccaatttgcactcgaagttttatcacggctagaaagcagcttgctagtctactcatatccaacgtcatctatgtgccaaattttgtttaaccaccagtgagttgagattagaacgggctgtgtaatcaaatgacggactaacgtagcgttgccttcaggcttttcatctttaaggccggagacgtggtctaactacgagctgcttctgtacatcgagttcatcaaaaccgtcagttgaacgaacgtctaatagttcttacagttatttttttttattaaaaaaaaaatggatataaatggattcaagttcattctataacacagagtatattgctattcttactaaactctatagggtagggagtactacctgacatccttgtatctgagctgagaacttggaattgaacctccttccagagtaagcataggcacatctttcagatctctttgccttagccttgtgtgggcgtattagtctgatgcctaactatgatgtgatctacagcggttatagcatagatttggaggtatcttcctggggtgaagccacatagaaaagttaacttgctattgattcgcccaaggctactcctggcacctagactatactatactgtggttcgctggtaaaattcaagggaattccacaccccaatgccacgtagaggctcaatgctttacgatattacactcctactcgacccgttgattccatggatgctgtgggctcattgggatggaatctgggccataatcctctgttgtgacccctacatgtgtggtccgtaggatcgcggtatccgataaatcggcgccgaagggggcgccaccgtgattcgagtatctgtccccacgatgaagctccaaaggcttatgggaatccgaagaatatggtttcgccgggcacgtcccagagatctcgttataaggattggaaatcctggagccttggttgctcatctttgtattcgatcgcttcgtggtcgtgagccgcgaccatgacttggtgatcgcgaccagattctgtatgcccaactcgtggagagccaacggaatggcaggcgtgcagagcacgatgaggccacatgtggtctcaaccacgacccagattccgacggtgcagaatgagtaagtgagatcctgggacttggaatagttgatagtgactgcaagtcggaaacccgcggcaaaacaggccctttcaggcacatattgaagtaagcaaggagaaccaagactgtccgtggcagagtgtgtgacgatgacttacataaaaccgacaacgaatacagcagagacacctaggcgtttctgaaaggacatgcgaaggccccagatcactctttgagggagaatgagaatggccaggtcaatcaggaaattgatgacagatgatgtaatgtcgatggcgcggctgtcagaacaggttccttctacaagagggtcgtagagctttgcgtgaggtttgcaagtcaggttgatggcgatgatggctgcggaatagaacagcaagtctaggctgatcagaaaaatggagatccaccagaagtaattgcgtgtaccgacggggacaaaaatgtgcagccagtcgaccaagatggtggctttgatgagcatgatggtcgccgcccaaacatttgtggccacatggaacaactggcgcagtaagtcggtagttgttcagatagacatgtgtgtccatggtggttggaattggctgcgatactcacgtagaataatttcgacacgtctttgaggcggaaatcccattgatgaacgaaatacccaatgtgaacctggcagagaatcaccgtcatgaagcctgcatagaggccatatgaaacaagtgtcatgtctggatcaaggagcgttgattagcgagtttttacacggccaccctttgccttgctgacttacagtcactgatgtgcgccctcttcgaagaccgccacaagccgtatgctcgcgcgaaaacgaagagggatccaagagcaaagcaaaacccatagacgccatttgccatggtgctgcggttcggcgggctgttaaaatttggagtgacaccgctcggaggtgtgagggccggcccgttgagtacggcctctagctcctctgccgacagtgagttgaagtcaatagacatgttgtatggcctcgtgaaacggtttgatactcaatgcccaaaaagcaagggcgacgagaactattagagacaaatcaacacaaaggcaatggaagggaagtatagggagctgaagtaaaccatgaactaaaagcacaataaagcatatgtggttaggaaaagggagatgagaagaagggtggtggaacgagatgacgagcgaagacgtttgcgacgagggtacctgcgctgcatgaggaagcaacgaaccagagatcattcggaggaatcagcacctaagtgaccatgcgtgtgtcattgaaggattcagaacctcgccctcgggagcgggacttggatttaggtttgatcctgcaagctgctgatgtgaaggtagtggccaagacgagggttgtatcacgcccgggtattcccaacaaccaacaacacaagtacactttcacgccagggaaactgaagttccaccgagggcgatgctggcatgatggagcccgtgtccaggtttggaatcggatactacgtccgcaccaagaatatggagcactgctgagtacctcctggaatttgctagactcacctgctgggtagtaaccggtgccgaggcagtctcctcagtatcagctagacctgaagccatttcatgcgtgccttaatttttgcaaagagatagtgccgaaaaggccagctgtacaaactgaagtcattgtgttgagatgtcgggctctggcatcttccattgctgttgaactttatactcactttctcttacgtacacactgaagatgcaagtcaggtcgctcgagcggttagccacagagaagatagagaaaggtgttcattccacctgaaataccaagaacaaactagctgattggctgaccacagtagtgagacgaccggagtgacaaacaagtaactacgctttgcggcccaagctcatgcctccatccataatgacactggttcctgttgtgaagctcgacctcgaaccgctcaagtagagaactgagtcggcgacctcctccggagttgccagccggttcatcgggacacccgacagcatattctcctccaatcccggaacaacgtccatggctacctgtatcattggggtcttggtccatgctgggcacagacagttgacgcggatcccatcggataccatgtcaaaggcggcggtcttggtaattcctaggatggcatgctttgatgtcgtgtactgcaccatcccgggcacagagatgacagctgtaactgaagctagcagaacgatggatcctcgggtggtgcctcgcccaggcttcgttgcatcgactggtttggcctcctgggccttcatggcggcagaggcggcgcttgccaccaggaaagcgccgttgacattgacttcctgaacctttttgaaatcggcgaagtttgtttctgatatcgggccaaaggtatcagccgccatctgaagagaaacgacgatcaatcagcactcgtaaaagaacatgggctataggaggggagatggaggcagtgggcactactcacaccagctgaattgacaacataatctatgcgaccaaagagcttcgatgtatatgcgatggctgccttgacggcctcctcagacgtgacatcaagctggactgcctcagccttgaaattgggatgagtggcgacggctttaatcgcctcgactgtcgcctgggccgtttcgagattgatatcggtgaccaccacgccgttggaaccgtcccttgcaaaggcttcagcgctcgccctgccgattccgctccctgtaatgactcagtacttgatttaattacggacacaaagacttgtttacctccgccggtgatgaaggcaaatccagagacatccattgcgtgaaaagtggtcgttatgttttttggctagaagatgaacgaagtactggactggtgaataaaaaaggaatgaacaacctggtccgactggaaatgaaatttagtagcaacaaggcagaaagaggcagaaagaggtaggtagatagaagtaccaacaagaataagcactaggtaatccatgtgttatggcaaccactgatattaattactacagttggcccacctaaacttcaggctgctgcattgtcactgttgcatccggcctgaaattgctcaagggacaccagttggtccttggcaaccaaaattcctagacgaaggactactaagcatggctagatgggccgagccagcctcctacaacgagactttcgttcatgcactgtgcggcattgacccgccatgccaagtaggatcagagattgtcctatcagtctaaagatctgacgagattccgtgggtagatttgatctcggggccattgtgagctagcagcctcttccgttacaatgatggattttccaagcttgagataaaaaggcttggaagatgctggtcctcgcttggcttgaatgaattggcaacgctccaagacatatctgttattacgcagaacctggcacatcttttattcttggcaataagtttcttgaatcatgtctccaaggccatcggatgacgagcagggctccaaatcagccagcaatgagctcgttagccctcctccccatgatgagaagaagatcgcgactccggctactgaagccaatcctggcggtttgacctacatcaccggctggagacttcacttgataacggcagggtaagaaagacatcagaagaccgatccagcgcttctgccattcaactgattccacaactgacaattgctagcctttgcctgggtctttttctcgtcaactttgaggtaactgttgtcagtacagctctggtatctatcacgaataacctccaagattatgcccgtagtagctggatcatcacagcctatctcctgacttacactggtacgcgccttcatggtacctgtcatcgccgtcttgggagtctcttcttacttgttccttggcgaaataggctgcttggtcatttgggccagacttagcgacatcatcggccgaaaatgggcatgcgtctcttcctttttcatatttgctgcctggtcgggtgcatgtggcggagctcaaaccatggttcaactgtaagtccgcgtcatccttgcatttcttgttaacttgggatgaatactaactgtatcagtatcatatttcgcgttctccagggtgttggtggctctggcatgtacggaatgacaacaattatgctatacgagctcgtgccaccggccaagtttccactatacacaacctttgttatgatcctcttcgccataggattcgccctgggcccggtgctgggtggattaatcaccaacagcgggtcctggagatgggtatttcttctcaagtaagtagtgattcgcgacgaatatcaactttgggatcatgctaatgtcgccgcgcttggcaagtgtgccatcggccttgctcgtggggcttctgctctgcttcattattcccaaccgcttccctcaccacgggcatgccaccccccctccccgggccagcttcaagacttttgacttcattggttccacgtcaacgttggcgggcgtcacgttactcatcacagggttggaggaggcggccgcgtctcttcgatggaagacagcactcaccatcggcccgctctgtgcttctggcgtggcgtggggggtgtttcttgcgagccagtggtacatcagccgcccaggaaggacccgagtacagcctgttttcccctggcgcttttgccaagatcgagtcatcatgggcctctatgtgtaagcgccctggtcactctcctctaccaacagccctatctgcaatggaacatctgaccctgggaaaactaggaatactttcatgaccggagctgtcagtgtaacatgcgtcgtgctcatcccatttcgctatcagacagcggcgggtctctctcccttgcaagcgggtgctcgcctcatcctcttctccggggcatcgccaatcggggcgatcgttgccgccgcactgtgcaaaaagaggagagtgccaccgctatatatcatgatgtttggagaaatccttcagatactgggtctggttcctggccactactctcttgacgtcctccaacgaccgggatgagcctgctctatatggcctccaggtctgtattggattcggcatgggcttcgtaatgggtacggcgactttattgacccccgcgattgcggagaggagggaccttggtgagtccagcggattcgggatggctttactcattggactcatgctgactatcaccacccctcccagcggttgcatccgccgcagtggttcagtttaggtttctcggcggtgcggtcattctgtcgattgcgacggcagttgggaacatatggattcgcaactcactgtgtgacgtcctcagtaccgagcagctgaaagccctgttccgatccactcaatccatcaacaggttgccggctgacgtgcacaatgaggttaggggccattttgtgcatagtttcaacatgcagatgcgcattgtattgggggtggcagtggcggcatttctcagttctctgatgatgtggaagaagcctcagattcgggtgccttgagtgctctgagctgtgatttggctacctgatgttacccatttaacacgactcctgccagtctaccaacaggatttttgttgccacgaaatggccgttcctgcaagtatgcaatagattactgttggtcacgccttgtcactggattaattgcctcatactattaacataacggaggttcctttgtgatgtatccacgctgcgacctaagttccaaacccaccaacgaagtgacaggcaaggacctgtcaagagcggggggatcggcaggccggagcattccatccccccctcatcccctgtccgacctggcgttgcttaatctaaggtggatcagttggcctgccttccgaagttcctatgaacagtatgatgttctcgtatagcgggactgtatttcgatcggcccgagtctacttcgcaagttccaattcctgtcgagttgtcgccggttacaagtgattcatgcatttgatcctccgacccctttagcgtagctgttggatccctcttctaagcactgctaccacgcagcttggcggttgcaacagttggcgggcgagatgacttaattagattgtattaagcgccttgcgtggccagtggagaaagccattccgtgacaaagggccctgctggcttgcatgtgattagaacgatggttatgcaaaagtttagaatatagtaacccctgacgtggatatgattactttaggcttaatggttagttgctctatcacctttatttcttgattctagcaagcttactacactggctcgtacagctaattagcagccgctatcgcaatattcaggggttaagaggaagcacttatgtggtgatggaaattgagacgcgaacttcaaaccttcgagatgacccgtgatagaattgacgctgtggatttggggtgtgtggccaagtatatggaactgccttgactatagttcactaaggcgtgaggtgcgctcgggctttaggatacttcactccatctccttgatttggtagaacagtgcatgaatcatttgttggcttggtcaagacggacctattactgcatggaggtatttcggtttagcggccgacgcatgcctgatccaagggaagtcgttgggggacttgtctttgtcactcttgtcaggtaaccctggcgttgatgccggaggatggagatgtcacagtcgtgcggagttttgtactttcaatctctaccaacaccccatagcgaggcacacgaacgcagactggactcaccttggtatcatgggacgtctgtgaatcatcataagagaactgcactcgtttgccagaagcatctacctgcagcaatagaccaacagcacttgcgtttttattttagcatcccttgcaggctcaagtgcaatggatcttgacgcttcttcctcttcatccatggcagccggtgatcataacgtgttatcccctgaaagcctctccaaggcgaacagccatgcatacacaaccccaagatcctctgaggccagagacgaagatccagtatgtgtagtagggatgggtatgttgtctgttatcaataacaagtatgttggcttgaaattttgacagttacgtgatagcttgccgactgccaggaggcatcaagtccccttcggatctctggaagtttctcgtcgagaaaaaatcagcccaggggaagatccccgccaccaggttcaacgcctcaggatatcattcccaatccgctgatcgtgctggtgtcatgaatgtcgacggcggatactttatcgacgaggacctccgcgcatttgacaatggattctttggcatcaacaatttagaggcaacatacatggacccccagcagcgaaagcttctagaagtcgttttcgagtgcttcgagagtgcaggcgtgtccatggacgatgtatcaaattccaacacaggcgtatacgttgccagctttacgcatgactacttcttactgcaaatgcgcgatccagattatttacatcggtaccatggtacagggtctggaacgaccttgctggccaatcggatcagtcatgtcttcaacctccatggacccaggtaatccccattatcctctcagctgatgacacggaggctgataaaaagattgaagtttcacaatcgatactgcttgctcttcatcagttcactgtttacatgccgctgtatcggcattgaaggcaggcgaatgcgatggtgctgttgttgccggtaccaatcttttacttacacccgagccctttgtggcagcgatgaagacgggtgtcctatcgtctaccgcaacctgtcagacatttgatcgtaatgctgatgggtacggacgagcagagggcgttgatgccgtctatctcaagcgtttatccgcggcgatcagagacggggatgacatacatgctgtcattcgtgggaccgctgtcaactcgtaagtcatagaagtctagattctttcgggcgaagacatactaagtgagggcctgtagcaacggacgcacgcccggtgttactttgcctagcgcagattatcaggaagcggtgattcagaaggcatataggagcgctggaataagcccttcggacactgattatgtcgaatgccatggaacagggactgcggtcggtgatcccattgaagttgaagctctctcacgcctcttctcctcgccagatcgccctccattaatgattggctcggtatgtgctcattctcaatctaattccctgtcagtgctaccaagaacccttcaggctgattgaaatcaggtcaaatccaatctcggccacagtgaggccacaagtggtctcacttctctgctcaaggttgttcttgcttttcaacatgacaggatccccccaatgatagctccgaagagcctaaaccccagacgtgagcatatcaggaagagcggcttatgtgatcaagaggtgcctaaatttcgctaactattggttccagtgaaacttgacgactaccggatgaaaattgtcactgaaactgagaagtggcccagggacatcattcgtagagcgagtattaactcatttggatacggtggagcaaatgcgcatgcaatagttgagtctctcgacagctttttatggcgtacaggcgcttctcaagacgaaaaagtcagtgacgaaggggagaatatcacggtgactctcccaatatcagctgcatcccaggagtcattatctttgcgcactaaacagattatgagcctggcccagaagtctgatgctcggactctcatgcgattggcctttacattaggcctgcgcacacctcacctgggtaaaagagcctcgattgtggcaagagtaagcccccgcgagctacagtccgaatctgaagtcgcgtcggcatcccaggttaccgttggaaccggacagcggtccctaccccctgtcttcgttttcactggtcagggtgcacaatatcccaatatggcgcgtgagattcttcaagagtcccaatatttccgagaggttattcagaggctagaccaagttctgcaagcgttgccgtcgccgtacaaaccatcctgggcactgtttgatatcatcaaccagccccccgagacgacccaggttcaccaacccacttgcagccaaacagtgtgcactgcgatccagattgccatggtacagctattgaggacttggaatttccagccttcagctgtcattgggcactcgtcgggagaaattgctgccgcttttactgccggcctcctaaggtaagggctttcttcctcggctcattccacccacagttgctttacatactgaatttgcctgtttagtgagtccgaggccatgcttgttgcctaccttcgaggctacgctgtcgagcaggttcagaccaacggcgccatgatggccacagccttggacgccggaagtgctgagacccttatcaaacagctgggtctcgcagggcaactttgtgtggcttgttataactcgcctaataatgttaccgttagcggcgcaacggaagcccttcacactctttctcgggagctaacggcaacgaatatattctgccgcgttctggaaaccggagggagggcctatcactcatcggcaatggcagaagtcggaagactctacgagaagttattattggatgttgcgaatttcaaagacagagaccagaggaatgcgaatgtgcccatgtactcgacagttcattctacgagtagggaagccgcatttgttgactactcaacagacatgccgagctattggcgagccaacttggaaagccctgttcaattcagtgcgactcttgagcatctctcatctgctcatgaatgtcacttggtggaaatcggcccccatcctgctctgaaaggaccgatccgccaggcagtcacaagtcggcatctgccgtacacgcactcgttggcgcgcaacgaaagttcaagtttttcgatcaagaagcttgcgggaacactcttcaagtatggctacaaaatacactggtccagcgtcaatgatcttccatctatcgcccaaaaaacgaccgacgaaatcccgtcatatccatgggactactcaaacgggctgccgtggtttgcatcccgtgaagctagcgaaatcagaaatcgccgatatcctcgccatgaacttctgggttcgctccgggtcgctggaaatgggatcgactattgctggagaaacacactccgcctgaacgaagttccttgggtggcggaccacaaggttgaagaccagattgtcttccctgcggcaggctatctggccattgcaattgaagcgctatcgcagatcctgggggacagtatgccactgactcctgctatcgagtttcagaatgtgtctttcaatgcagctcttattgtgaaggatgaggggagcggcgcagactctgagatacatactgtcatggcaccacggcggctatctacgaagcaactgtcctctgtctactacgatttctccgttagttcttggaaatctaatcacgtccttactcactgctctggtggcatcagactgtcatcggctacatccagcgaaggttctgtcaatatccaggacagtgtaggctacaggatgtggcccatgaagcgatggtacgggaaggccagcgaggagggtctcgtatttggacctcacatgcgatctatcatcggcttgcaggcggatcgcagtcgtctgagttccgatagcatctgcaccacacacacaaagcctttggcgctggcggcttcaagcatctcctaccaggtccaccccatcacaatcgatgcctgcttgcaagccgccattttgagtgctgctgcgggtaccccaaacagtctgcgtccttatctaccggtattccttcctaaatgcgtcatgcggccatcaacttttgctgggcccagctcggaagcatatatccatgtccgatctcacaaaactggcatctccaacctcaaagcagactgcacgcttcgagatgctcaaggaaacccaatggctgactttgatggaatcaaattatccctttacgatggaaaacttgtcaagactagttccaatgacttgcacttgcagcgtcatccagtcatgcgcgtcttttggaaaccagacgctgctcacctgcatgcaggcactcgagcgcagctcgatgattatattgctaaattctcagattctcatgatcaagagtttcagtctcgagaattagcttccgttgcggcattacttgatcttctgagtcataagaatccccgtatccgagttgtggagattcaggatgaagctacatccgaaccccagaaccgatatctccagctcttggatgacgggacagcatatccccgttacgtttcatggtccaagtctgtggtgggggaatctaaccgactaccaatactaggaaatggggtctttgatgtcctcattgacacagtaagtgatgatactctattctcgtccctgcgcacgtggccacggctaatgggccaatgcagcgtttcaatcctcaaatcccatgggatcagctcgaagccaatctcagtctaaatggaagcattatgacacgcaattcagaggaagcttctgcgattctgcaagccaaaggatttaccacgattccagtccgaggggacataattcttgcgacccgtgcgctgccacaatcaagtttagagaaaacagaggcaattattttggtaattcacacatcccattttatttcccacgagaagcagtatcactaacattagacctcagactcgtaaaccttccttgaccgtacaaaagctcgcggactcgttggagacccacctccgtaacaatgatgtccaggctgtgtctgtcgtcgaattcgagagtctgtcaaacagctcaacaattactcgggaaacactggttatttcactccttgaactggagaacgaacttcttggcagcctgagtgaggaacacatgaacctcctccgcaccgcgacagatactgtcaaaaatctcctttgggtcacaggtgccaacatgctggcagaaccaaatccggatttggcaatggcccccggtttatcccgttcgatcatgatggagcagccgtcgctgaacttcaacatcttggatgtagggccagtcgtgggcatgggacaggcttcgatagcaaccacttgtgacaatgtggtgcgaatcatgttcgcgccccgggctattaatgacaaggagttcattcaacacaaccgcctcctatacatcagccgtctagggtctgacttttcgaccaacgccttgttccgccgccggctggggatggagcaagggttccaacagacaactctcggaagtgccggcaatgctcgtctagaagttggacagcccggcatcactgactcgctatacttccaacagcatccagctgagctttcagagtcactccccaagggttacatcgacgtcaaggcccaggcggtcagcctcaacgcaaaagacatttatgctattagtggccgggtagaaactagaaacgccaccaagtctctcgaatatgttggcatcgttacggcaattggtcctgaagttgaggaggacatagaacttggctgccgtgtgttggtatgtgcacccaccgattggtcgaccatggcccgtgtgccagcttggcaggctcacaggcttcttcctggggaggacacaaaggtcatggccaccttgcccgtggcatggggagcggctctatatgccgtccgtgaacgagcctacttgcgcgctggggaaactgtcctggtgcattctggtgctggcgcttttggatctgcggtgatcagattggcgcagcagattggcgcagaggtctacacaaccgtcggcgccagaaaaagacgagagtttctaatcaaggaaatgggtatgggtggtcattcagaccctgagcagcatcattcatcattgctaacctctttgcttaggtatacccgaggatcacatattctgttcacgagatgagtcgttcgaggaagacatcaagaaagcaacagatggacgtggtgttgacgttgtcatcaactctcttgttggtgatctgatgcacgcgagctggcgttgtgtcggcgattttggccgctttgtcgaggtagggaagaaagagctgcttgacgcgggtaagcttgacatgtcggtcttcgctcgcggcgcaactttcacggcttttgataatacggagatgctgtttcatcctgatgattactacagaaaaacatatataaggtttgttggtccccgactcactttccacgttggctattgctaacggactcaccaagcatggtcaaggagattctctccatgtaccggtcaggaaagatcaaacctgtccccatcatggaatttgatgttagtgagatttcacaggcataccgttttttctcgtccaaggacagagtaggcaaagtcgtcatctcacttgaaaaccttaacagcattatcaaagtgaggcttttcctgtttatgtgtctttttttcctgatctcataagacaagagtctaacggatggattttcgagctaggttatgcctcccaaatacacatcacaattcgcgtcacacaaatcatacctgctcgttggtgcgctcggcggtctaggccgaagtctaagcagctggatgagatctcagggtgcccgcaattttgtcttcatagcgagatctggcgcttccaaaaaggaggccaaggaacaagtcgactatctaagacgctctggagcacgtgtccaggttgtccaaggagacgtatcaagaagttcggatgtcgaaaaagctgtcgctgagtccaaggcaatgggtccgataggaggcgtcgtccacgccgccatgggtcttcatgaggatctatttggtcgcatgaccaatgagggctggcacaccagtgtccgatccaaatggcgaggggcgtggaacctccacaatgcccttcagagccaggctgcgtcccctgatttcttcctcctcgcctcttccatgactgggacggttggagttgccacggagaccaactactgcgcggcaaatgcgttcctagatgccttttcgtactggcgtcgtcgacagggtctccctaccgtgtccatcggtcttggaatggtgtcagaagtcggatacttgcacgaaaatcctcaaatagaagccttgcttttgagacgaggtatccagcctttgaacgaagatgagttcctccaggttgttgatcttggcattagtaattctggcagagatatcggaaactccactgtgaccaactcccacatgctcactggtatggagacattcggtgttcgtaagcttctcgacaagggctttgaggtgactcacaccgtcatggacgacgagcggtcgtcgattctgtctgcagccttggactttgatcgaactagaaacacaggcgacccaaacaatatctctagcggtgcaagtcttggctggatgaagggccttcccgaggtagcagccaagtctctcatgaaggagacgagcgccccatcactcaaggaggcgctcagcctcgtgattggaaggaagttctccaacttgattctcatgccctttgaaaagatcgactatgcacggtcatttgcgcagcttggagtcgacagtatgatcgcgtctgaattccgtgcctggttttggaacggtttcgctgttgacattccattcttggactttttgagcccggacaagaacttggaggctgtagtatcgtttgtggaggccacattagcaacggagtcgaagggaaagcttggaggttagcggtagaaagtcctacagagaccagggaaggtagaaatacctaaccatgctcgcatctcggttctcgggggacagaacttccttccttagttagtatgagtagatgttttagatcccaaggcctactagcctcttgtgagcgtattgctttttttcctaacagttgaatgtaaagacagactcttcggcaagcctctagaaaggcgggaaacactcatataactacactttctacgtgttattaaaaacattttcatcccacttcctcactgctattcaaccgttcaaatatggaacggtgcatctggtgaagggcaatgcgggattcagacctgttccggaaaagtaagaaagtccgaaaatattaattccggctgactgctacataactccgtacacatccctgattgcgttcaagagatacgctgaagaagatatgtacggctttcggcattcatcaactgaaatgccgtgggttagggattcggacgacatcacaggaagcctcacggagatagctagctttaggcgtgttgtaacatcctcaactgggcgtcggtaggtataaatacctacgattctttcgcggatagtaaaagagtgaaagaaaaggggtaaaataaataaacaaatcgaacagttactgaacgctctaccaatccaaaatattcaacatggtcttccccaaccacgtccttcttggcgctgcggccatcatccccgtcgcagatcctgtcatggtttcgtccatcagtcctgtcgttctgccctatcccgaacgtgcgattgacatggaactccgggttactgcacctctagacggcgacgatcttccagttgtcatcctatcccatggccagggcaacagcaactggctttcttccatcgctggttatgagcccctctacaactactgggctggccaaggctttgtggtgatccaaccaacacacttagggtcggctacatatggcctccaagcgcctccaggcaaggagtacttttgggaggcccgctgccaagacattatatggattcttgatcatctggatgagatacaggaggccgtaccctctgtcaaaggacggctggacacggacagcatagcgatagccgggcactcgatgggtggttggacggcctccatgatcctcggggcccaaaacaccagcccgctgggtaacggtactgtttccaagtaccgcgatacacgtatcaaggctggcgtcgtccttgccgggacaggcaacggtggtgaagatttatcggaccaaggacgtcagatggtgccaagctacaatcccgacttctcaacaatggagactcctgctctcgtagtatacggagacagcgacttatctccttacttgactgtcagaggtgctgactggcacggggacgcatactatcttgccccgggccccaaagacctctttattgttcgaggcggaaagcacggtctcggcggtgtgagtggctgggatgctctggagactgaggatgaaagcccagagcgattggcctcggtgcaacgtgcaacctcggcatatctcagggctgctctctatggagacgactcttggcagaaggctcgtgctgcgcttcaaggtaattcgaccttgggcaccgtggaacaaaagttctaaccgtagttcttgggaatgcacctttgctggtgggtgaggatcaaactaagtggccggatgatgccagtctcctggggctgatcgtggatgttaccccctacgtggacaagaagtgtagataacttggcaggtataaggcgctctggtgaaaacatagacaactagtcccaagtactctaacaatcttcattctttgtagttgcgatcgcaataccttgcgacaggatcttgtaattagatgcacatatatactgcaatagaaatctgatcaacgtgcccttgaaaatgtgtgtataaaataagtattaggatgttattaattactacaattgatagaggcttgtctaaccgacaagcgaccgacaattttctcattattcaatcttaacaaaattgtgcaactcggactcttgcccctgtgccctgcaaaaccctcgcatctcgttccttagatcgctctgaagattcgagacttaatgacagcctcgcatcagggaagatagcagcagatcaccacatcgtctgggaagggccggggcaccaatgcgggttggcgagatgtccaatagaaccctagctaggtgccatggcccccatgatttgaagccaaatttgatgcttgcgcctggattgctggcccctaaaagcgaatccccgcccccaaatcgtttccaagtggccgttgcgatggctgccttggcgtcgatcaaaaccttgtccttggacttttgctgatagggttaagggggaggctgattcctgttcttctcctcggatttgttcgatcgttcgtagatagtgcgcccagcgaacgagacatgcagtggcggatcggcagagatgaccgggggcactgccaatccgctcaaaggctaatgtgagggagctgacgcccggcggtgctgtcatgttttaattgggatcagcttagtctcagctgaggcttggctgagtcaactaaggcttgtcgcggtgttcgtacgcaatccatgtcgtttgatttccgccaatgccggtggtagagacttttgctgtgcaaatgatctcgaagcccgatcattttcggtgaatatggcggtcaggggggagagagagcgtactcgatcaatctcggtaacatgacgaagaaactgtgtgttcccctcggtcgcccatcagcctaccatctccccgacggctggctgctgcgccctgctcatatcagccgagtaggtcctcgtgaaaccagaaattccggcgtcgtgtagcgatgtgccgctggcagagtgggagtgcccgcgacggcccccagccgccagttcagctctggctttctcctcttcgtcggtgacctcgatggccggcatggccccgtagtactcgctcccggagagatcggtcgtagaataggcaagggcgtttcctcctcccggcgctccataggaaagctcgctccattgcgatggcgacggctgcggcagcgacgcgaggtgcgagtgctgcagcgagtcgtacttatatgtgcggtccagctgggacggcgtgtaggatttcgtgttggtggtgtggtaggactcgacggagagggagttgtggtttacgctgctcgcattcttggacgactgggcagcacggttggctcccgcaaatggctcgtaggatgtcgaaggcagggcaccggacctgatgccgttctggtatcgtttcctccagaaccaccagacgaggccgcagatgagccctccaccgacgagggtcgctgccacggcgatgcctgcgactgcgacgttgctcaggccgccctcgtctgcgcgtgtttgcaggcgagactgtgccatgctcgtgtcgtcgctcacctcgacaaggctctgctcggggcagtagccgttggcagtattgcagggatcgatggcgcagcagccgacgaagcgagtcggtttgttggtgcagacgtagaagctgctctggccggggcacgtaccgcccaagttcggcatcacggtcattgattaacagcaatagaggtcgattcgatgggttgtgcaggctgtggcgagggttcgccttgtcggcttgatgttgttttggattcgtatcgtcggtttgggctcgctcgcagaagtttctcgtgggatggtcacagctcgacaccaggagtgggcacttggatgcttaaatggacccggcgatgcggaaaatttaaatcaatctaagccaagggaagggaagggaagggattggcctgacgtacggatgtaccacatgatttgatacgaacaattttcacccgagtgtacacctggactgcgcccctcctcacgctgctccgtctccggatccaggaacacaggtacaagtacgcgccagccgcccccaaatacgactttttattagcaccatcttgggaatggctgtattatgagcattacgatatgagatgggcggggctgacacatggccctggcccaagctttcactcggggcaacgaagggaggttcacggggtctggatgctttgtccaaattctgacgggcttggcctaagaacaaagcttgagacacaaaaggcctcaggaagaatcattatgtacgaggggaattgttgagggcagcgcgtgtctgcaaagcccttgtttacgcccctgtatcaccaaattccaaggtcagggcaccggtatccgatccatgtctcacccatttggctacccggcgcatgaaagacgccagcatagcagaccaagctagagtctagagcctccaaagcgtccaaacgacggctctgtgcgccagtccggcagagtgtagccaagcggtgtgctgaagcgaggacaatcctcgcctccaatcgcacaccggagagcgacatcacccctgtttctcagcccctgtcggcattgtctcaaatcttgcaagtgcatcttagcggctcaccaggcggcacgattgtgatcgggtcctctcctcctcctgtcccgttctggttccatttgtcacggcctctgccaatgaatctgctcatctgctcgcacttatctctcctccagggtgtcagccaggggttcacaccacacaggctttgagaatcctgaccaccatccgcgcttgggagacaacacctccggaactttgttggcgcgctcataagcgcgcctctcctttcgactgccatcaggatgcatgcgtagcgggctgggcactcctgaagagcccccaacgcttccttaccgtctctcgctaactgataagaatgaccgggttgggccacagggcggcaaagcagcgcaggagagccatcgaccagcagcaactcagcttccgcgggcgcctatatggtctagaatgcactggaaatggtggtgtgtgcctggaaggattcgtcgcagatgaaactaccagccactactaacgcgtagcgcacagcttattcaatgcaggctggtgggatccctcgcaagaggccagccgcgaagtgagaacctctgtagccgagcccggaccaaagccttggtaataattacatgtacgctctggccatgtgacatcgcctacccgaaggagaactgccttgcgagcgaaccatccacgcgtgctatggctccgggattgatattgggaagggttctcctttttccttgcactccggttgacctctgaatcccagcgcctcgcaggtagcgtccgcgtgaattcgacgatcagcggatccttgcctgccagctgagcttcgctatgactgcctgtagaattctggatggaagtacccaggaactaaaatcacaagccagaacaaggttttagccggtagggctggagaatcctttgtccatctaccaaaacagcaggtagaatggatcgatcactgagctttgtcgcaagatcggttcatcggacaagaaccccggctcaccctccaggatctgattgaaaattcttcctgacgactaccctacaccaagccaagctcttgagaggtaatgtatccattctcaggctaatgagggtctgtaaatacatgtgatactcgttccaaggttcatcaagtgggggcgttcgtatcattgtcgctgcagctcaagatggtttcttggttgtgatccatcaattgacgaagtttgatcacctaccctggaccacgaggtgtagagacagcacaatgatcgtacaatgccatctttatttatcttgccaagattttcatcgttctccttgggaacggaaatatatcttccaaataatttcagttatagattggtatcagtttgtgatcctgttaatttaaaaggtcatttgtgctatagtaccgaggataaatgctgatgctaacagagtcgctctcacaaaactaaactgaagctacgtgaaatctaaaacatcgcggcagcctgccgcaaagccactgtagtaacattcggtcttctatcgtagctaagccagtagagttttgtagtatatgagcccctgtgactatatcagctgttcccgacgacgactagagtgtaggatatcattagcttagtcttgtagacaatgtcaatgccaactccttcgataggttcaagccacctttgatgttaaggaagaatttcttcacgctatccaccagcaagatcaaactatatcccaacagtttgcggggagaatggagaaataatgggagcattgctaaacacgagtgggtatgatgatcagttgaacctctttcatgaccatccaaatctcaaatttacacaagcaggcggacaaacacttgaaagcaccagagagctcgaattggcaatgagatatgacctcctgccagggttgcatctttcgatcagtctgtgagtcaggccgtcatctgttgcggctttttcaatataaactccgtctaactccgggcgtggatttggcaggttgctaatcaagatttgcctctttctttccgccatggaaacaaaaatcatcaagactttctggtctcttggatttgattgcatctagtcctctgatcaagcagtaagatcacctacaataggctagtccacaatcccacatatgctctccaacatggcggcgatcaaccccgaggaccccgagttcccccctctagcaattgatccaaacatgttccatcgactcccggaactgcgggccccggatgacgactggacaggcattagtagctccgcggagcgaaaaaagctgcagaacagactcaaccagagagcttggcgtatgtcccatgcccggcgtcccatggacttgcatgctgacccaccccgcaggcagaagaaagaggatggaacgcatccgagagaagtctatccaagctcttgccaacgggcgggatgactctggtgcctcacagctgactatagagagcgagctagggccgccgcttgacgttcttcagttgttccggggttatgacatgctccacaatgccaggaagaagaatgctgccatgaatctagtgaggcgggtttatgaggaatacaccctcaaacttcctcgcccggacagtcttcccttcctgattagactgaacctgctcaatgctatggcgagtaatgcacgccatatcgggatatcgccagcaggtctgtgctgtgaggaggtcatctcgccattcaacctcgctggcccgctcgagccatgtcatgcattgtcattggtcaactcaccggctgctctggctccgactccgacacaatatcgggtgcttcaccatccttggattgacctgataccgttcccggcgctccgagacaatctcctcgaggccttggatgcaggtttcatggatgatgacgacttgtgcttcgatctggtagacatgggcggtgtagagacggacatagttacccggccggcaatgatcgtatggggggctgcctgggatcctgagggctgggaagtgaacgcggcgtttctgcggaaatggggattcttagcgagaggatgtcccgagttgatcgcggcgacaaatgggtggagggtcaaaaggggagaaaagccgtttatcatgaaaacatgaagattctttaaaatcaggtcgggtgggcaaaaaggactccgggcaaacgtaacatatgattatacgaggagttattctgtctctttctttcggtaggcactctcaaatgaaacgccacagctatgtgagaaatcgtgtttctcggtatataaactgctctagaagttatagatgtgtacaaagcatcagccctactttaaagagtcctgaatgagcttaaggagatacgactctgtccatgtccagatgagtgtgctgtcgttgtctacaaaagctgctccagtccagaaagtatttttctggccctctagtttgtagagcttactgtagaacccctcacgaatatcctcaggagagacatgaatgtggtatggtgcatgattcccgaaatacttgaagtcgggttcaccctgaccaatagttcctgcctttgccaagttgtccaattcgcctttgaccaagtccttaatgtcctgttcggtcaaatcgggatccaaaccaccaaaatatgccgaaagtttgtttgtcgagacattgccggcaaggagaggaccaattgaatatgacccggggagtgttaaaaggttgtagggagtattcgtgccaatgttaccgaaactcctcttggtgtcgattccctgatgagtgaagacagtagacccatataagaaacccttgaacttggaaaacagttctgtttcttctgacgtgaggtccagcccaatagatgtaaggctatcaatcgttggcgggatggcaagcaccagtttctttgccttgacaaccacacggccctttggcgtcttgaccacgacttgcacgccgtcttgggatctggtaatctttttaatccgcgattgtagaacgacgctctccttgtcattcaagcgaccctgggcagctcggtatagatcgaggttgtttccggacgcagcattgatgaacccggccgcagcggcttgtacgagtagagggctgaacaccttgaggccgtagatggtaggcctctccaatagattaccgttgcatccggcgatggaattgacctgctggactatgtctccgaggtcattgtccttgatgaagtctgcataaggggccaggagctcctcgggaaccgggttgggcacgtcatagccgagagagagatatgggtatttctcagtataaatcccggcatacttttgaatggcagcccccagcgcctcgggggcgacgggagtgtacccgtctacggcgcgaccggtggacaaatcgacgaagacttgctctgcgcctccgaagctgacgttggcgagcggcactccgaggctgccgaagtagtctctgacaattgaggagttgtggtagacaacgactccgaggttgaatggctggttggtgtcagggtccgtgtacgtgaccgtgtgacctcctaggtgatcgttcttctcgaggacaacgacggaatggccctggtccatcagccgcatagctgcgtaggtgccggatgagccgccaccaataacgacgacatctcgctccaaaacggtatcattgttggagcagggtgtagccgtagccaccccggtgattaggaacggcagaatttgggttaagaattgcattgtgtcggcagctccctagagacatagagagtttggtctaagggagagagggaaattgtcgctatatattgtgtttttccatatttgtatagtcggatcgtcatcttagagcatgctctcagctttggcccgccaatacgcgtatctttgcgcgcggatggatgatcactgtaggggtttgtttcgagactaatacaggccagccataagccctaggcttgttacattcgacatggcggattttccttgccggcttcccattctaatttcgcggcggcggccgccccagacatattaacgctaaacgcagtcgcaactgcgaccccgccctttgtcggtttgcgtggcgttgtctgggtggctttgatgcgggatatgatgtcaaccaacatgtaagaagaggggcccgtggagatcggaaatttggccagcggaataccacctctttcacaaagatagtttccttcttgtcggtttggaagcaatcttggaagcacgtttcaaagctcaatctttcgtgcttttgtggggacatgcaagcaaaaagggacgcggtgacatgcaaatgagtcctaatatcgagctttcggcgagtgccagatgcaaatggcttgtgtcccaaaaatagattaactctccggatcatccggtgtcattctttcttaactatcgttcaaggtgtcaccattttactaggggctagactacaattttcttggggcctcgttggggtctctgacctcaaccagaagcttcccggtattaacacccctgagcagatcccggagtccagcttcggccgctttcaacccgccttttaggatggtttcctccttcttcaatttgccctcagccagccactgggcgagttcggttcgagcttgtgggaactggtccttgtggtcgaaaacaatgaatccttccatccggatacgcatcttcatgagctggcttaagttttgaatacccttgggtacgccattgtattggctgatcatgccgcattcgatgaatcgagcgcgttccttggcccgggtgagagccaggtcgaggatctcccctccgactacacacaacggattagttcgggactttggtcaaacgaagcgaatcaaaccgtcgcctccacttctccgcgtgggggttttgcgaaaggggactgcttaccattgtcaaagtagacatcaatgtagctcttggtggcctcgatgaatttctccttgaaatcctctgccttgtagttcaatgcagcatcaaacccgagctcctccgtcagccagcggcacttgtcgtccgtccctgcaattcccacaaccgtggcgcccctgatcttggcaatctgaccagcaacgctccccgtggctccggcagcccccgacacgaccacgagctcgccggcctgcggctttccgatgttgttgaggccgacccaggcggtgatgcccgtcaatcccagcgccgagagcatgtcctggggcttcttgacgggggggtagctggcttggggctcgaactggccgtccttgagaaccgcgtactcggtccatcccgtgagggcgacgacgaagtcaccctctgcggcgagctttgacttggtgacgaggacgcgggagacggtgattccgctcattcttgcgccaatggcgacaggcggcacataggatcggcggtctgggtttgaattagaatgcagtaatggaactcatcatcatcggctttttggagcggtggccgatggcttacgcattgctctgcattcatgtgatagacttacctattaactgcgcgcgcaaggagggatctagggatagatacagaacctcgaccagaatctccccatcctgcaggtcggcaggtgacggaattggagtggtctgttgtgagaaggtctgccccgggatgatctctcccgtcgggcgctcagcgaggtgaatagaaaggttctcgagcgccatggtgagctgttagtggctggagagtgctatgcttcgtataagtcgtgcaactggggtgggaaaaaggagaaccaatctgcgggtcgtcttcgattccttgggacaggagcgtggtggcacgacaggagaacctggaggtcgtgaagcccggcaattgcgtcttttataaatctaataaatcgagtggagtgtcggcgccggtacaggatgaaatattgagtgcatgtgggctgggtactggcgcgcgctcgctcgcctcacattcctcaggatcccaggagtttcagccggggcctgcgggcaaaaaagacggacatcgtacggagcgtaactgctttgagaagcttcgaccaagagccgccaacgtagccgagaggagaaggcagtaaagcggaggagcaggtgggaggatgcttggcccgtgtttgactgatctcaggcatatcgccgtgaagtggcgttgacgggcgcgggcagatggccaattctgggcatgtacatactacaatttacgaatggcataggcagcagcaaaacttttagcaaaaacggtcgggacgcattttacgcgtatcaaacaggggtcgatgggttagcccggaggggcagttcatcatccccagcacgtcagagacttcagagctcaatgcgacaaaacggtaggtaggaagaagatgtggagagctcagagatcatggccctgctccttctggaaaccagccaaccagcctcttgctctctaggcagtatgtgccgaggcataacaaagctgtagcccctcgcggagcacgcctcgctgatcccgaagacgatgggttcgctaggctatcttggggacctacgaccgtgccgtttcttgggtgacgcagctgctaggagcgctgtatcatgtcgttctgttgcatcatgcggaggcggggacgggctcgggctcggtgggcaaatccggtaacagggccggctgggtggcagacctcgacagcgcagaacgaccctatgtgggtgttctcggatataggactgccccgggtgttgtctctgaacgggacatgtccacctggagctgcacctcatccatattggccgccaaggagcccaacaccgctggtgcaacacatgatcatgtagagcggtggtgtgtaatcgcctgggttagcgtttgctcaacaccgataatgcgcatgcatgatacaacgtagtggccgatgagccaaggaatagtgggctgatgatgcctgtctcaaggctcgggctccgtgagatctgaatgggcgggccgggattcgttcaaatccgacaagctcgaccgcctcttgttccaaatatatccttgctcgatgagcttccctttttgcttaccaatcctagcaaaaagtaaaatctcggctgtcggtcaaacgatcaaaacgctgagttgcgagaggaaaatactacctggaacactggagggtgttatgaggttgagcaactcggagatagactcttggcccgacatcaatcgtttttggccacaataatacttaccggagagcttattgagcttctctcgcctgaatataccggttttgggtggtgagtcatttcaacattcgaattctagatttggcgtcttttggggaagattaaagtgtaatattttgtatcgctcggagacttagtaaacaccacactgaaatgtgatctttttatcaactgctattgtcaaattcaaaaccgactggaaggattcactataggagaggttaattatgtacaagtttgagaaagtagccttgatgatcaccgagacaggtcccaagtgcttatcatgagacaattgaggtagggttaggtagtgaagacaacctagcacctaaatgcagataactcttgctatatagatacgacaataaaatgaataattttacatggtggttcttgttcctattcaaccctactgaatctatcagcgttctgaacccaattcttccctgctggggcattgttggagaacgcggtacaagtaatgtactcaaaagctagaccattcatgatgttcagagaccagaattgggactgctgcacttggaagttatgaatttccgagttggtgatgttccatagaacgaacggttgttgcagagtgccgtgttagcgtgtgtgtcgtctttggaaagtcaccgcataccatagggcgtccttcagtcgagcttcccttatcttcgtcgtagcacacgtccccatggccatctataccaccctcatcataaccattgaggcggattttatctccagacaggatgaaccctgcgcggtgactctggaactcgactaagaatgagttgttcctccaatgtgtagtgtcaggggaaaactaatctggcttagcacatctcctgccattgcataaaataggttgactgacaagccatgttccatgccaactgatgtccacatctgtaagccttgcgtgtagcttttctccaatccaatacttttcgccctttgggaatattattgtggactttctgctgcatctcctaaacgccgtcaagatgtttggtacgtcattttgctcgccaccatgcgcggtgacggtgcaggtccgacgaccttgaggtggacacacgaacactgccttcgcagacaacaagaggaagaaagagacaagaaatgaagatataccgaaccattttgtaaacttcaacttaggctgccgtggtagtccaagtagctcgttccaacaccaaccttttatagaactcagacttcggcgtaataaaacagcgaggttaatactgatctatcaatgttcatagaattccgaccgtgtggaacgaacgaatcgaaattgtagttgggtgaatcatgtcaagttgaattaggttagtggcctacggcgtgtacccaaggaataaaacatgaaggctgctcgagaatcaatcattccaccatttagctcttagaacgtgaacgcacaatagagccaacgttaatttagaaccattgtgaatttgattagctatctactttcgctatatcggggagatgcaccccgaggccagcatatatgatataaccgttctggagtctcgggctcggtggctcggtgcaaattgaacgaagccggagggtatgttgcatcagacatcttggccatccccgcacatttatcattgcattttcaagatgagaggatctatgcatttggcactgccatttccacaatttgctttcgatgctcctaccagctgaaggcctcatctatgaatacgacgccacgattggatttgccagaactagcaagttcggtcaccactttcctaacctcatcagccataccgggtgggccacaaactacgacacctagattccctcttacatcctcccggagtatttcggcttttataatctggtccaagtgcatacggataccgatggtcgtgtgaagctccaccttcgatttatattgctcgagctccggcttgatggagcgcaagatatcgtcatgcttcaccccccagaaaaccctggcaggaataccaccgaacttgcttgcaataggaagcacggcagtgataccaacaccgcctgcgatgccgacaaagctggagcattctcttaagttctgggtggaaggagttgcatggtaggaagactcaatcagcactcggatggatagagttcctttctgggcgcgaacccgggagagaagggttgcagttgtaccattttgggctcgtaccaggaggactgctttggcctgagccccgtgtggaacagaactggttgtttgattctcttctgaaggagtctcgccaccgacatcgacagccgtgaccgcgtttctatttcccttttcactatcaagttctgtatcgcgatttgtgccggattcttgtgggtttagttcggtgaagctggagagaacagagaatgggtggttttcccagacacgccagctcagtgatggaaagtagagataaacatgcccttccacaacgacgtcgtcgatttcgatccgcagcaaatcactgctctcgtccacactcgtgactgttgctgtacggaacccattggcggcgattcttactacccgcaaggctttgtccatgaaccatatgccacctgcagcatagatccaaatctcatagccccaattgtacgaatagagataccaaatatggagaaaccctgctatcaagatgagagcagccaagatctggtgaatggcgagaaacacctcgtacatcttctggcgcagagacagcagagacagcgggtacatgaagcatgttgccagtgttgcaatgatgccccagtaccagtatgggagcttgctctcagtcgcatggtcctgccaaccgacaaagtagtgaagaagaaggatcgaatgcattacagtctggaaaatacagacatatgccacccatcggtggagtaggaggtatgtgctgtggctccagtctgtgacccaaagcagaatgttgttccgactcgagaaaaggaacagagcgatatataagcagaatgcaagaactccggcacgatcaccgatcacctgaacacgctgcatatggtgactcaccattctgacatttggctgcagagttctcagaggtaggcacaggaggataacattgatgataatgatgtatgcaatgaagatggactggcctcgagttggcatgtgccccaaattcccgtaaacagggacccggtgttggtgaccccaaagaggcttatcaaggatcgcgctgatgcgactagttaatttggcataaccaggaatgaatcgacccagcgaaagaagtatgggcaaacaaacgagcgtgattgagatgatcagactggttcgaaaacgttagtagggtttcaagtacttggagaagtcattcgaacctgttgacaccatgatcgaattctccccactggaaggatacttgataattgagagttgcaatgtattctttttcggcaatacgacttgtgacgttcaggggcgcctttccggtgatgtaaggaacatcgtcctcgcccactttcttcacatcatcttgcgcaagttctagagcctcctgatatgacatggcgggctccatgtccttgctccaatcgccaatcgacccagtggctaaatgtccttcccaccatttttcaatagtagaaagcgaaacatcgtcacgcgagcagtacttgttgatgcagagggcgacagttcgtaaaaaggcatcatcaattaaccagcataaggggtctttagccgacgaggtgtgatggctctgatgagtgctgctgccgtcgtctgtctggcacaggagagggttgttgcgtaccatgtaccggcatgtgtgagcacagggtggcttataaagccacttaccagctccaagtataccaacgccatccgcactgacaagaggcaagcaggttgccaggagaatgagacaccagcgccttagtggtgctcgtttggcttgaggagatcccatcgtgggatgtactaaaggcgcacacaaaagtatgacaccttgatttgtccagaaacaagtctgaaaatgaatcgaggcctaacaactaatcgatgcattattaatgagatattggatggttggatttgtttagtcttaattttaagcttcttttggaagtcatgtcacatccaaacgacgctgataaactgcctcatacttgctcaaacccgctatttcttggcaacgatccgggatggtctgtgagggatatgcaaggtattatcgaaaggaacttcgacccccattctttttcagggttagagtagcagtggccaatagctggaccagtattacagacgtgtagagctaggttctttcggtggtgtcacatttgtcacaggaaggggccatgtaatcggtagtctgcctggatcagggctataagctggaaactccggtccagatcagggtcttcggatggaaattctctgttcagcgggaagccatgtgggcccgtcgtatggcgtcctatgagaagcgatatattgacagtccagcctgaagccattgatctacttgctgtcagttagaagttgtttgacccacacgcctctttttcaggaggcacaaagcggttctaatttggggttctatgttttgagtgagctgtttaataggatcaagaatgaagttgttctgtcatttgtaaaagagaatggatgtttcatctaggcatatgcctacacaatagagggaggtatcgatgggagagacctaatttgtgcaaactgatggaggtggacgcctcttggcgaaattgtcttggtaatgctatccaaagtaactaaggagaaaggtcgctttaggcgtacgtgaattcttcgggagtaagtctaggctgaatgtgaagattgcatgttttcggcgatgcttctgcacacaggagcctcaagtgtcggatctcggcccttaaagccattgagtagtcgatccgaagtaagagacgcatgttcccccttttccattctcaatgcttgaagcgtatatgaccttgagtagctggcgcgcgccgtcttcagggggcactgggcctttaaaacgtggcgaataggtcttaagtttcgcaccaaattcactaaatctggccgcgtcactttccgaaactatatagagctcgaaattagctgaagcaagagaacatatgcgacgtagaaagacttacatgaaggcttcactccctcgaaagtgtcaacgctaccggcacaaatacccataacgaaaacgccctcgctcttatatgtcacgttgtactttgccaccagcatattcagcgctgcttttgatacagaatcgggtatgcctccatcaatgcctgattgattaacgaagtcgcaactgcccatgccacttgtcaatgcaatgatcttcttaatggagctgcgttggaccaaaggcatgaaaacagtgatggtgttgattaggccaatgacattaacccgatacgacttggtaatttcagtctctaggaaatctagatcatctgtaaattcggcgaggtttcggacaattgcttctcttgacttgtatgccgcattgcagataagataatcaactgctccaacgatttcttcaatacttgcacgagcggcctgttgaccttctgttagcatctttcaaacttgaaaatgaaatttaaaatccataacagtcagggcagaatggggtgttaatatgaataggcgcataccttaagctgatcaaggtttgtaacatccgctttgaaaacgcgaacagatgtaagcccgtcctcatcaagcctcttttgcacagcaacaacatccctcacgaggccaatcacgacattacttggatcagcggccaagactttgagaaaagtatactgtttcgaattagaggagtgatgtgcgtaatttaggtgagggtaacatacaccaaggcccctcgaggcgccaacgacaacgtaagatggcattttgcagaatgagtttagtgatgagcttagaaccgagtctggagtgaggaatagtgagttcggattcgagacatgtcgaggttttatatgtctgatttctagattacaggatctgtgcctttggctgtttccgtggaaccccgtggctcaagtttcaccaaaacttcttgatgagcggtgttggtcatttgacccatgtgatatccgcctgacgctattctagttctagattaattcacatgatcgagagcttgactgggatactcaaagatctatattcaggcaaagaactcgttccgtcatccgtgagttccgggatccgagctggctgcagtttgccccgcagatttgaacagcaacctcacgcaaccttcccaatattgcctagatccagccccggtctcggagttctgtgctagtttcccgacatcttctcggggttggaaactctcatcattccacaatcccacccgcccgggaagcacgaatctttcttcaccaatacaaatctcgcgcagtgcgtatcgcattgaaggtttacacaatatggagccactgggtcaggtgtccggagcctcctttacgtgccctatttgtcagaaagcgttcagtattcgtaagtgtctgaccgacgatcctgatctctagacttacgagggattgcgatgcctgattagaaattccctggcgcctgatagtgcacttgtagctttttgagcattctttgcgacttgatcgctgacatcactaggctcctcatttggacggcattctagacaatgtcttgaacgggaaatctcacgcccgagacggaggtcatgcttgcagtgctctaaaagaaagctcggctgtgaccgaaagcatcctacgtgttccagatgcgcttctcagggcggtgcctgtgagtatgctacatctggtcggacctcgtcaacggatagaacacggatcacgcctccgtcctctgaacttggccgcgaggatagtgttgcaaccacacttgaggcaggagacccagttacttcacatgcattgtcgcaagttacaaagccatctccatgcactggtaaagttaaccagcagctgcgtgggactcaatcacagttcgactttgcccttactcacctttgtcgaatctttcgaacatatccgcgaatgctcgcaacttgcgatagactaccgccctttattcatagatcacagataatggcttcgaatcttccgatgccgctctctaactgcctcgcgttatgtcgaatgtgggcaaacaactcgtcagtggagactgggggcgactttctgaaagtttcaatgaagacagaactattaagactactaaatgaggtatagccaatctatattttgaagttagctacttgagatctgatcaggttcaatagtaccgggaatatgatggtgctactttggatgccgcctttcaggcggccatcatctacgctattgcactgctttttcctgcaccacaccagcctccatccagaatgtttgacctctcaaccctggcagctctgaaagagtttggggaatacataagatccggaaccgtcatgatgccggaggaggtctctcatacccgtccaccctggcaacaatggctgcaagtttcttgcaagcgaaggtcgttgatttgcctctactgcttcgagtggatgaatgcgatgttgaataacttccagagtttcccctgcaccaacgcggagtacatgccggccccagcgggcaaggtgctttgggagattactgcgcaagagaagtgggaggtcgcttacgatcgatggttgggaagatgggctggtctggatgtgttcactttaggcgatctcgaaaatatgatgccggggccgacattggaccttcgctcagaaatgtggttggaagaggctgatgagcttggtatattattgatgacgttgggtctgtgatgctccctcatcttttattcacgaagctaaactcagctacaggccagaaaaattaagggcaagtcaaaagacaaatcagagaaaagcaaacgtgacaaacgagaagccgggctctcacaccaattacgcgttggcccatgataagcatatctgggcacaaacttggaaaatgataataccttgtcatgtgagatgacgtgaaagactttccccgtcagaagagagccagggtttgcagaatgaattggaggcttagatcaattagtttctgacggaaggacgatgatcctaagccctccgtcagcagtaaccagaatgggaagcaatatgagccattaggccaaccatgtgtgcatctaatcctgaggataagaacttataaaactgtaaaatattgataaaactatagcctagcttgactatttcgaaaaatcatgatttctattataggataatacgtatgaggtgaagcgaggcaaaggatctaacaactcataaccggatcatgacttcatcatggtgttcggagaacccttgacgtatttgaactcatgatttgtaatcaccaatctggaaaatgagtcataagagcacgtccccttattggtcttgtcccttgaggttttaacctctattaacccagtcccgtttgcgaagttcacgtataggctgggtgacgctcagaataaccattcgaatagaccaaaaatggaggccgaaatgaggattttgtccacttcccttgatcaccaccatggcaaaggtataaacctccctaatatcacctcacaggtgagattgccaccaaacgtggaaaggagagagacacagaatgaaggaagtcagccgccctctgaatcagtctctgatctcagcccaagtggcggaagctcgggactgtcaatttccaagtttcgtgccatcaccgttatcacgaccctcacaggcatcaacttcctcaacaccatgggttcgggcattctcatagctgcccttccccgcatcgcaagggatcttgacattccacaaccgctcattctctggcctgccgctgtctatgccctcgcggcaggatgcctacttttgatctttggatccatcgcagatgttctcggtcccaaaccgatgtggtgcacgggaagcttcctttttattgcctttacccttggggtcggcctttccagatctgctgcccagctcatcctcttccgcacgttgctgggtgttgctatctccatgtgtctccccaccgctctatctctagtcacaaacaccttcccaaagggcagctggaggaatgctgcttttgccattaatggcatgggacacccgcttggctatgcattggggctcgtccttggtggtatctttaccgacacagtcggttggcgctgggcttattacatgatggcaattatcaacacgattatctcggttgcatccatctggtcactccccaacgtgaacgtggccacagagcgctcgaagaaagatagactgatgtatgatattgattgggtgggcgcgatcattatgagcgcagccttgggaatgttgctttatgtgttggccatgacgtcttcgtcgtacaaacgtctcgatgagcccgtcaacattgctcttctggccgtatctctgtccctattggtcgcatttcctttctggatggacttccaggtgaagaaaaaccgccctgccttgatcccgaataaaatgtggcgaaactggggattcacctccatttgcgtcgcagtcttcctgtgctgggcttcgctcaatggaatcgaatatttcaccacactttagtaagaaacacatgctgaatacgagagagtggaaatatggctaacaatcacccagttttcaagaagttgaaagcttgcccgctctgcaaagctcactccgcttcattcctcatgtcattatgggcgtggcagtgaatattcttaccggctacctcatttctagggtcaatgtccgatggctggctgtgacatctgctcttatcagcatgatcgcagcccctttgatggcaacaattgcagttggacagtcctattggtatgctccattttgggctttgtttctttcgcccgtgaatccagatggtcagtgtgaagcttcaatctcattatgatgatctcttcggtgtgaattccccatgtgctaactcgatcgctcctttagtcttgtttacggtatccaacctggtaatttccaatgcctttccccctgaggtccaatctctagcaggaggcgtcttcaacgaagtatcccagtttggcaattcggtcggcttggctgttgcagctgctattgctgcatctgtcacagaacattcgggaatagaagattcagcggccagtttgatgaagggctatcgcgcggccttttggacaatttttgcgagctgcggaactgtgaccattgtgctctggtttggcctgaagcggtccggcattgttggcaagaaggacgattaagaagtgttccttccgagttacattgaggaaacaggatggatttctagaggaccaaaaagaaactccctatgtatatggctactctactacaacccaagaggacaactggtcatgagactggcatatgtttggtcttcgactctcaccaagagagaacattaccccccatagtctatcaggcatcttcctccttaaaaggtcttctataaatgcgaggaataaagaaaagtgcgcgaaatatatccctccacgaagcatctaaacattttctttgttctcaacctctgtagcggtgacgcccttggcctcggcgaccttatcggcgaaagaattatccatgcccgtcctccaggcggggaggttttcatcaaatacgcgatcaatctcctcaagcgacttctttgaagtttcgggatacgtgaaaaagatgtggaaggtcatcgcaatacagaaggtgccaaagatcatatatgacctccattggatgtttgtgaaggaaggggggacgaagaatgcaagcgcaaggttgaatctgtgaactgtattaggaaaatggtctcttttatctgttaaaggatcgaggatttaaagcttacatccagttaccggccgcggaaaggccaacacctttggcgcggtatctcagagggaagacctcagcgcagtaaatccaggcaccgggagcccaagtaagaccataaacaccgacgaagatatatgccatggcaatgacggactttgccggtgcaccggagattgaccatctaagaatagtgttgccttcatagtattagcatcgctctgatgtaggggtgccgcatctacttaccatcgacgctatcaaccgcgtgaccatagacggccatgacagcacctgtcacgaaatgaaggatgccacagataatagctccggtaatgagaatccaacggcgactcagacgatcaacaataggtaacataacgccagtggtgacaaggaagatgacgtattgtatgatggacgacgtaagagcaatattgccatactgcagttgcaaaaattagcgatctccaatacgtaaccatcatggcttctgaacttaccacgccggccatgttgaaaatatagacaagatagtaaagcataacgttgccgccaagaagctgctgccagacctggacactgacaccgaccaatgttcgcttccagatcccgggtgcaaagaggcctaggtagccgatatcttttgattctgaagcgactcggactgcctctcgcacttcctctagctcagcaaccacaacggcgttttctctgtcgcccttggcatggagattggccagaacttcgtggcactcctcccagcggtccttgctagcaagccagcgtggagactctgggaagaaccagagggcgacaaagaggatggcaccagggatggcctggacgccccatgcgatgcggaaggcggaggggcccttgacgtggagggagcagccgtatgagatgagatacatgatgagaatgcctgtgaatcaagttagcgattagccaatgaaacctgatttaaatgctgcataccccattcaatcgaccactgttgaattcccacaatcctgcctctaatagctgacggagccagttcagccaagtacaccagaacctgagaactggtgacgccaatggctagaccgcctacgatacgaccggcaatgaggtggccaatattctgggacgaacattgaaggacagcaccgaccacccaaataagcgaagcaattttcagtgcacccttgcggccaaacttatcggcaaaccagccagcagcaatggcgccgatgaaggatccagcggacatggaggcagtgatgcctccctgtgtggtagaatcggggtggttgaagtactcaagatactgctctgagccgatccaggcgctcatggaactgatctcgaagccgaagagcataccaccaattgtgcccaaggcggcaaggactggacagactttgtgagtgattgagatttacgattgtctggcctctcacttactgtaaatgttccagatcatcatgctgggcaacctgtgattctctattcctagatgatgggacaagttgagaatgaagtgtgtctgtctgagaaccgatattcataatctgagatgcgattctccacgtcctttatatatctctcctaaccccatggcacagtacttggggcgtaaatccccatcctcctcttgctttggagaaacgaggagtgaccagctggatccacaatagaatcacaatatttccctctgtgacaccatcagcgagttgttttaggcagggtagacagatgagtggggatttgggtattctggccccggtggcggctatgtaagcgcacgtatcagagcccgagaaaaggctggagacaaggggctgcagctggtcggaaagcaatgattcagcgcaatgcaaaaagaacgaagaaggcttctagagcggctgcttcggcgagattttttacctctgagatcgccgcgagctgccggctatattcttgcatgaccttgacgtgaaacgacggctaattatcaaagtcgcggatggcagtcacaataaggtgcggcatagacgatcactgggcgggtaaagactcgagtcgtgtcttggcctgccgagaattccatccgcgccatggtatccatatgatgatatcaccagttttatgacagcctacaaacgcccatcggttacaacggaaccagcaaccataagtcccataatttcttcacgccacgatctgatcccgggccgaataatggataccggctgcttaagagaaggccaagcactccaatgattcttgtgaacggggcactgaaactggggctccagatggccaagcggtgtctggttggggagccactgtaatgggggatatcccctgagtctttggggccccagggggagactactggagctggacgaatcctccaagccaagcaccgtattgttatcaggcgatggcgccggcgaagtgagaagtcaagggcccgctaataacaggccgctccacagctaaaacatccacttgccgaaacatgtaaggaagtaaaggttgtcgagtttactaaattactctcattggggcgcttaggacgagttgtgccttttgatgggaacgatcgtccttgcggctggcttaagagagtttggctggactgcgacgcccgatgtcagatttgatgatgcaccaaggcgatgtgtttttgagtgcgtcatatgtcttggcgagactgggttccctgtcgttatgcctcatatacgaccatgatcactgttcattgcgtgattatgtgccaacagccatgtccatggcacagcagcggaagatgaagcgtagagcgtccagttttcgacatcgtgttgatgcatgggagctctcacgcggctgaagagatatctgacagggatgtttaatgcctgctagaggttgccggttcagctttgcttcatgcgagcgataagacttgcattgatgctgcccttcaacaatgtagcattgcatttcgcttctgtcagtctatgcattactgattcaagcagtattcaaccgttcgtagtcttctggagataatacttgagattgattttgcggcgactgcgaatcaactattttcatgagctcccagatatgtgctgatgggtggcctgtgcattcgcgtatcaagcaataacgcaagtgtggtggcattcaatcctagggaagcattcgctcccgcttatgcaaattgttcatcatcttgccataagaatcaaggtactccgcaatgagagaaggcttcgtgaatgaaaacactcccgtctggtgtctgtagctgaggcttcgcagcttgagatcttgcgagatccaaaattgacgtcatcttaattctccacacatttcatcgttcataaatttgaaatgcttagaaccaggttgacagcttcgcaggtcgctgcttcagccgtttgaacactaggcaattaattgaaaggctgatcgagccgttctacaaatcaataccttcagtagtaagagaatgcgagaattaccgaatcaattggtgaccagagctgctctgctcgatgtcccctggcccggctggcggccactgcagaggctgagcttgactccctcggcgatggccatcggaagaggaagagaataaagttcaacagcaatgaagctaccatggcccgacaactcaactcaatgaatacgaaatcctaaaaatatagccttttctagtctgcccaagatatagtcatacggtaggaaaattctggtacccaaggctagatcactgcagtcaaatgcaattatccagaagaacaagtagggcagtcggtggcacctacatgacacgaagagaggaagggttagaggagatagcattaatagaagtgcttttaagctttaaaaacacagtgaaagagttgatggccatcggctcgcacttagagacagtgtgtggctgcgcctcattatatggcgaactaatatcttgctagccctccctagtctagttgctggtgatgccgagctggtatgtagttaggatgaaaaggcagcctatatcacaggcttgtttgagtaatttataagtgattgaatggatactggctctcatctacagcgaaaaaagcgtggatcggtgggccattcaagtaaactgaggttacgcctcgatgggatttttcttctatgtgtctcttttagcagcccaaatgatacctcggtgtagattccccaaaaaccatgaatcctgatatgcctcatcaaagtgacccagagcggtataatagactctcccggccccaacagtttggcaccacgatagaggaaagccagcggactcatttgtcaagtcatcttcgccccgagcagagagtagtacagttcgtccctcaacgaggcgcgggtgagacctgaagctgtatagttcatcaaaccaaagaaactgcttctctgacccagactttaggctaattgggcatataggggccgaagctggcgcagagtccatcacgggtagagattcgtagccgttgatgtaatgtttggggttctcgacctcaagggctatccattgcggtggaggatggccattgaaaactgcaccaagtatcttggtgtatctcgcatctgtcttcatgccggacgtggcggcgtgaatgccgacaacaccaccaccgttctcaacaaagtctcttagaagaacggactcgtcttcagtcagatattcgccagtattatggccaagtgcaataacatcgtaatcggggagcgaagataattgactagaatcctcagtatgcttcatgatgactggaatcgagccgaaagcctcaaccatactaggtatgcaatcatgacggtaacctcgagtcttggtgaggagtaacactctaatagtggctggtgtatcgggagccattctagaagaaggtatcaagattcgtagcttggataatgtacagaaagtattgactacggcataaatatagacactcactgttgcatactgaggaggactgcatgctgacaaggtcgtattttgatgactcaacgacgtcatgactcacaccgagttcgacattaaccagtatacccggacgaattgagacgggccaactctctgtgcatactaccacccctacagctttgtgcagccgcaaagaatgcaaccataggtcaagagtgtcatcctattagagctgacatgcgagctgatcagatatgtgtttcttttaagataccacaaaataatgtctcgtcattaccaagtggctgattagactcatccccaaatgccaaaccgctttaaaccacacttggtttttccttgcttcagcacttgtcggtaggtcaccatcagactcggcatccaaacactctatggtgatgtaatgggtaggattggctgtcggcttcgtcggcctcttcagttactgcttagagactgtgcagggaattgactcctaccagaatgctggccgcgacccatgcctgcttgatgcagggctggaagctattgtgcaccgtttcgcgtgttggggtgacggtgtcggtattcgcgaatggaagctttagaataaccatcacccagaccttaacgatccaaggacttagtcgtccaagttttactcaagagtatcgaacagagaacacctccatatccatggcagtcacccctcaacgcctctgattttccaaggctgcaaaagactcgctgcggggtaaatcgaggtagacgagccatttatactctaccattaagtaattaatgcttaatataattagatacttatcccttgtttttatttgcactgtttagtctaaagatcttagtaatctctttgaattctatgatattgttcagtggatcttatctgattgataacgaatatttttctggacgctatactgaagtaagtcgtcggagtgctggctgagatatttgcaattgccggcttttatccaggggtgagcggttttccacacacgtctggccatctacgtcttgcatcactgtatccatcaccacgaatattgatacgctcctccccaccgcttgatatacaatggacgagccatgggttgggtatcagctacccgcgagaaaggtctcgtggctgaagcgtgatactctgctcttcaacatcagtatcggatgcaaagcagatgagcttcattttctctacgtatgtatgtcaacaacaggtcgaccgaggacggcttggcaatcgtcacatatactaagcagttatactctcgataggaacgccaccctcagttttccaccttcccgactttccccctcggcttaggtgcgtagcctgcatgctattcttcttggccaggccgtgaaagcgagaagcatcgttgctcacttccatcccagtattcaagctcaacaatcaagaagtcacagacttctatgccacacaaggggctgtcaagatacccggtgtcccagagttggacccggtgcgactcgttgatggagaccggacaattgagatgctcaaactcctgcccgtcacttccgaaggtaggcagttcgaatttcgatccaagatcgtcggtgttttcgacaagggcaaagcaggcacagtggtccggactgagcacctactcgttgacgctgcttcgggcgacatctacacccgcaatgtgggcagcgagttttatgtagggcagggtagttggggtgggccgagaggacatcctgctcaaagatatccgcccccggaagggaaaacggccgatttgtcatttcaagtccacatcgatgcccagagttcacatttgtacaggtaggatatcatatccatcgacggagtctccagtctctccagctaattcgtctgtctaggcttaatggagattacaatcctctgcatgctaccccagagccgggtaaacagatgggatacgggggactgattaaccacggagtcttcgcctacagtgttattgcgcatgaattcgtgcggcggctagggaaatccgatccactcagcctccgacaactatccgcaaggttctcggggcctgtgaaaccgggtgacgacatagctatcgaggtctggaatattgggaggaacccagaagggtgggatcaaatcaggtggtttgcaaaggtggtaggaagcgaccgtccctgtctctcggatggaactgccttggtgaaaccgcagtacgacactggtaaactatgagtgctagcaatgccacctatcctggcaagaagcatagtctagcactagtcaatcgaagcacgcggttggtatgggatattgacaggtccagcataacagtccgccagtgcaggccaagtctgcaacgccgcagctcgccaatggagatccttacgagaggtagtccgacgagattgctcagattgctcatgaataattctaaactatagtctagtacggacatacatttgtggtgctgtagtttggaacacatagcataatatgtgactgtccctcaagcggccttgagagtctttagcacaccctcaatctccgtcttatgatcctgcagatccttcgccctcatctccgcatagtcactcgcgatggcattggacacttccagtatctttttacacagctcctcgagcttctcgataagcggcgtgaaccccagcacattaaccgcccgggcagctgtcgtgagggccggcgcgacctcctcggtctggaacttgacgaggtcgctcttggcggcctggaacacctggaacttggagacggtgacacctccggcgtggatcgtgccgaacgactggcggtcggggtagtgtgtcgtgagccacgctctctagtcggttaggacgggctgtagcgccttgcaggcgccgtcgtaggcgtctatcttgcgcttgaacgcgtccttctcgctgcccacgagcttgtctcagatggtgtgtcacgccgccatgcccgcctccatgcccagccccagcacggcgcccttgagcagctccatcgccagcaccttgccgaagtccttggccttggaccacatgcccagctcgcctgccttcatctccacctcggcggcctcggcggacagctcccggccatctccttgctaatcagctcgttggccgacttggcgccggcttcagcctcgagggcctcggcttcgcgcccagcgcgacttcctctatctccagggccacgcaggagccctcaggtgcgaggccgtgagcccctcgcagcgactcgaccgtacttgaggtagttaccgccgcggaaggagtcacggtaggtgggacagccgccgtcgaggctgccgaagcaactgtagtggtcgaggccgccgtctgaggagcagtcgccgagggaggaggagcggcagcagcagctggtgaccaagccgccggagcggcgtagctctccctcctcaggacagcggcacaggtgtcgcagtgggtggcgcgccagatcgccgagttcgaggcgtttgacctcggcatgcagggtcgagaaggccatcgcgaagctgtacgaggtgatcaagtcgcccaaagctaaggccatggacgacattgtcaagaagttcaataccgccattggcctgctcgacgccgccctcagggactggtcgaactagatggcggcaaacttcgacagcaaggggagctttggtaccatccagataccccatgtcaatctctctcgctttgacacgttcaggaacaggattggcgtcttgatggacattcgctagaagcagatctccttagctgcggtggcggcctccaaggtgccgacgctgccgaattatcaggccctagacactttggattatctgctaaataccctctcctactgggacgctgtaatcgaactcggcctccgcgatcactagcatagttatgaagtcccgattcgagtttacaagagtcccctttgcgaagagatcccccaagtcgagctctcacaggtaacatttccttaacagtcgataagaatattggagcatctcaatatgagtctccctgaatccctgcattccccctgtatctgtgctttgttaatttattattgccaggtcaaatcattgcgcacttggctatcgcaataactatgtacacaataccccgcttgatatgattacaatccattatatttgtcactggctctgctgctagccagataagcctggtttccatacgccccaacatgcatgtcttgtaggctgttagaaggtgaacgtgatcattaggcctgttgaaaggccctccgcgtatccccatctccaatgagcgtgcaatatagaacaatgctgcctaataagccctcctagatgacaaacttgtcagaccgtcatgcgggaggccagccattcccccacaaaatggcgagagatgactggagctgccctttgatgtgtatccaataacaaatctaatgtgctggccaaatatacgcatttagcagcttgtcagatacaatattgcacaatttactggattgggctagagatgatagcatcgtggcattggtagttccacactccctctgatcacatgctttatgcactgaacttaaaaggatcgcactggcaaaattttcaaagcaaaataataagtacttgatgacaccctgtctaaatctgctaatcttcaagatctcaaaaactcaatcgatggttaaacttttcctagtagattgttgaccttgcgccagtccagccacaactctcttccgatgtctcccactcagacaagctcttctaggcggaagggcataaagagccactatgtcgtggtgaaagggagggatatatccaagccaacaatattcaagtcttggtaggccattaaactagtgttagcgatgtttgatcactatgctgaatttgaaacctctagggaagatgccagaatgcgaatagcaaactttgccggaggagagtgcaaggggttcttttctgaagccgaggcggaagattacatttacagtctacaccgcaccgccatcgccgaagaggccggacagaccgggatcaaagtaacggaggagaagcccgttgaaaccagcgcaaaggtattttacgctgtttttaagggccgcaaaactggcgttttcacatcttgggcgtaagtcatacatttcattaacgagatccaagacggagccactaacagattcaaagcgaagcgagtgaacaaatcaatggcttttcggggaattgtcacaaaaagttcaagacagaggaggaagcccggcggttcgttgatagaacgtatacatcaatggaggatataccatcaaagaacattccacgaggggatgaaggtgatggtgacaagagagatttgtccacgatattcattcagctcaatcttcagtccatgtaggctgcaatcgagaaattatacaattgaatctttccgatcactcgcagcctgtttactttctttctgaggcggaacgagcagagtccccccagaacagaatttaatggtagatcaagctcgtacgaaatatatccgtgcatgtgcgaaggtgtccagatgttttgtaaatctaaacccgatagctgcaagtggagagtatgacaaggagggatatgttctaggctcacctcgtcccaatatagcggccgtagcggtggctcagatccccgcttatccaaggatgatcccttcttatgtatctttatgtacactcaacttaagggcagtacccgagagcataagacacataattaatccatatcactcagatatgttgaagtctggaggaggtcttctttaagccgccaactgactgggtcgatcacattggcataacacatgccgtggtttcacattaaatcatccattcagttcaaataatcagaatcttgaagagaccctatgtatccagttaaactttgttaaatagtggacagaatgccaatttccctctgtactcccaggcgaatgcaagccttgtgggtccttgactgaatacgacaagtgcttgtggtgaggatgaacccaatattgaacacctacacgcttaacgaatcgcttaatgttcaatttgtcatggaataaaggaattacagtgcgggggtcatttgtcaaccgtggggagaaatttggtagtgtgccatgtcgtcgtataagacaacgcccttggctaccatctcacaatctagatagaggtgtggaaaagagaaagacttacatccttactcgagggcgacgcgtttttcccaatcattcgtacacaagccaaagcaatggatgacctacccgccaacaatgtatcatcagcctccctcgaagagagcttgatcatgaactacatggcatcacagctgccaaaagtcgttgtgttcggcccaggttcaaattgcacgctcgaaatatgccccctcgactggagcgtctacaaataccagccatcgctccctgccaacgccacttttctcgccctcttcggtctagctatggtcgtgcatatttatctcggtatccgctggcggagctggtggttcatggctttcatgatctctggttgcatattcgagatgattggatatagtggtcgaatcatgctctacaaaaaccccttttctttccccggcttcttgatccaaatcatcactatcactggagctcctgtcttttttaccgctgctatttatgttaccctgtccaaaacgcaagtattcctttgttcatcgattaatcttgagcggggactaacggaatgttttggatcatttgtaggatcgaacatttctcggcagcactgtcgcgaatcagacccaagctgttttattattttttcatcccttctgacattatctgccttgttttgcaagcagccggcggtgcagtatcgactgtgagtcgaggtgttagccagagggggattgatatcgccatggtagggctcattcttcaggtcgctgtcctcgtcatatttattgcgctttttggtgactacatggcgcgatatcttcggtcacaagtcacgcaaaggtttacagcgagagagacctcgtttttcatctgcctcgccttggcaaccgtgttgatcttggcgcggtgtgcgtatcgctgctatgagctgaaggaaggctatacgcactctgagctgatcactaacgagagcctattcattgtattggagggggcgtaagtcatactgtgttcttaggttcatttgtaaacagtgctaaccgttctcagtttggtttatatgtcgtcactactactttgcattgggcatcctggtctgatctttcatgggacagggtgtgaaaagcttgaggacgatgatgtttcaggtgatcagattccgctggaacaatttgtgtacagggaaccagagacggaaattggagtagccaagtagaggagcagaggtgaggacctaaggccaactgagcttcacaatgagtccatctattgatgatcgccgtttagaagccaggggacacacaaaagttcaacccctaatccaaataattcgaaaaagagttccagtacaaaataaaaactagaaagaaaaatgcttgacctcaaatctcagcacaatcaatagaatccaaataattaacgtcttatggcgataagccgcgatgatccgtcggtcgcattctggtgagtatagggtagatagccgaataggtatgtggaagtttagtcagcaagccctgataagatatgacccgataaggcagagcgataacaaaaattccttgatgtctctcctcatcgagtttcaggcctacgcactcaaccacatccatttgagcacctgcgattaggtactggatagggaacaagtcgataatcaatcccaaaaactaagctgacgatggctaccgttgtgcccccaccctcgaagaggcagcgacgagaagcgcttgaacgcacacaagttcagcaccaggatgacccgagcgcgcaggtccagggttctttcagaactcgattcatcgatggcgatggccaacaactggctgatgtggtggaagtcaacttcgcagatgcaacagagaagaatatgtcacagttattgaacacactcctgcagaacgacaaggaggatgcggtgccatacagattcaaaattctcatctccgagtcgaacaaggtcatcaattcactcccagccagcccagccgatctccctgaactcctgaaggcacacggcttaacgagccctgcggaagcgatcctgagctttgtcgcagagccacaggccgttttcaaagtcaacgctgtgtcaaggttgtcccaccgtatccccggtcatggccagcctattctttgtgcccaattttctcctgcaacgagtggccttctcgcaaccggaagtggagatcagactgcccggatctgggataccgtgacaggcacaccaaaattcacgttgaagggacacacgggcgctgttattgtcgtatcttggagtccagacggagagctgcttgccacatgtagtatgggtgagtaacgatgcagaatcacactaccgacactctgatttacctgatgtactaattcatcatagaccagactgctaggctttggaaccctcgtacaggagagtcagtgaacaaagtcctcaaaggccacctcaaggatatcagagccctcgcgtggcagccatatcacctttggtccgacaacacacctttccttgccactgctggaaaagacaccacgtgcaggatatggaacgtaaacacgggtcagacagagcatatcctcagtggccacacagctgccatcagctgtgtcaaatggggaggcaccggcggtgacaaggggacgatcatcacagccagtcatgacaaaactctccgcatttgggaccccgtgaagggcgtgttattgcataacctcaagggccatgcccactgggtcaacagtctggcgctctcaaccgattacgtgcttcggacaggctattttgagcctgggactcaagtccccgccacacctgaggagaagaagcagaaggcaaaggagcgcttcgagaaggttgccaatgtgaaggggactctagttgaaacaatggtttccgctagtgatgatttcaccatgtatctgtgggatccagttcagtccaaggataagcccattactcgcatgcttgggcaccaaaagatggtcaaccacgtggccttctcacccgatggacgacttattgctagtgtcagctgggacaaccacaccaaattatggaatccgaagtaagcagagcccatttccagcaatcaagcatatatctgatccggagcgctaactcaatccagggacggtgcttttatcgctactctgcgaggccacgttgcccccatttacttgtgtgccttctccgccgactcccgcctccttgtgacagcgtccaaagacacgacactcaaagtctggaatttgagaacgttccagttggcaagagatttgccagggcatgaggatgaagtttatgctgtggattggagcgtcgatggacaacgggtaggaagcggtggaaaggacaaggccgttcgaatttgggccaactaagatttctgtgttttgttcaaaatttttatatagatgaggaggaaaagttagtgctttgcagctagatcagcgaatagagagacatgacctattgccacataacgattatttatgatatgtagggcattagaactttgggaaagtgacagtcatactatgttctattcaccgaatagatgatagcctctttttattatctgagtatataccctctaactggccgcaatccgtggaatcgaacagcccattcccggccataatgtcccagaggaagcatcagctgttctgccccattgtagagtacaaccctcacaacttagtggtctgtccttccactccaaggccgtagcctcacaagaggagctccgtgaacttgcatactcctcggagaattcccatttccctgtatcaccattcttgcgtatatatcggaatacgagggtctcccctgcatcctctaggacaaacacccttcgattgagccgctgccactgctcttgaggcgtcccttcattgaaattctccgcctcaatcatgcggttcttctttgcaatctcaacgagagcctggctgctccaaagcccatcctgtcgaggatatgtttccaagatccggattgcagtctctctagcgatagggtcgcggcagtttatagcgacgaaaactaaatgccacgacaacccggtatgcatggaaaatgttgttgaaaagcgttttgcgttgactactcgtttttggaggagaatctcgcacagttctaggagctctcgacactctggagtgattgacagcacgtactcatagtcacaggctgcggagaacatgctgtatatcgacatggtcaagtactcaatgcgaaggttgaccagacataaatatgaaggggattctcctggggagtgggtaagagtttgttgatagaggggccagaatgctcggtgccaaatctgcaaatgagttttcactttgttcgtgaatgcatgaagctctgctgaatttcgaagacgctggaggtattgctcgacgctcatatagtctctgggatcttggacgagcagatcatcaatgagctgtacggcgcttggatccagtatctcaattcggcgaacagttgcattccagtattcggctgccgtatcggcatcatgaaacagttttggctgccaggctaacccagctcgggggaccatatacggagtcaatcctgcgcaaagctgttccctttcgtccatctctgaatttgattctgcctcaatgatacgggaatgaagattccgctcctgaatcgtcccgctcatcacagtttgtgcttgcacaatgaagcggttatacaagagtatgacctcatgaataagttcaccaggacttggcgcaagctgagccatcttcgaagaagcttcggggcctaagcaaagctcccttatgattaacagaccatgtgagacatgccttagcgccgattttatgtcttgacgaaccccttcgaagctggtgaatagtatcgagaggaggatcgcttcttgtaagctctttgaaccttgatttgagcggctaactgatcgaagcgcccgacaataatacgtaaccgcatgctggtaatgaagactgtccgggttggactgagttagctgaacatggctcatagctccaattgcgagagcggcatcgcggaggattctgttttgagccgtgagctgaggcaggaaagtcgaccaaagcttgttcgaattatagccgcagaggaggtccctagagagatacacccattcatcgaaataaagctgctggaatttatcctcaaattctaggccaagtctgggccccttgagggaacgaggtccatgtgggctattgattatcggaagactagcaggttgctgtcttcgagcacgaattttgcgaggttttatccaatagccaccgcattctccgcttaaagataaacagttgaggcatgcaggcttcgtttcgtcgcatttgatatgccgttttcttggttgttagctataccttagattaagagagcagcgggggtccacttacttgcctgagaacaaaacaaggttagcaatcaggacatcaagctttctgtaaaagaaaactcacaggttacacagcctgttcggactttgggtgccccggccctcgacagcttctggagggcgctagcctgttttcctggaaatgtagggattgaaccctgggcctgcttcggctgtatcggtcttggagccatatgcgaatgggtagaaagagaaccaacttgggtcatgtctgatattacacaggcagaaactagatatctggctccaccataagagcgttgaggacgaaactcgtcatcggcatcgtggctgggcctcgcaacgatcacggcgaagaggcgaagtggggaagttgattaccaagtaaaataagccgagagcccgaatttacgacggttgcatctggccaatcacaatgggaatatcaggcggagttgatggagaataaagccggttaaaagagctgacagcttactgatcagcgactgttccgttctgggaagcaggaaaccttctgtgaaatccagccaatcaacgatgcaaagcaatttacgatgaagtatacgattaaatttacgacaagggtgtgattggaggcttgggcaacgcttatgtagtgaagttacgaacttgggatataggcatgaagaagtaggagataaatgaacgtggattatttgaataatcataggtatctataaaaggaccggaaggcgcacctgttcatcaaaatcaaaccatcagggtcaaaaacttctacattttatctattaaacttcaccttccaacaatttcataagttggccacccaagccaaacatctaacacttcattcacgcgttcagctacaactttcaaacaattctaaactcgccatcactcaaatagcttcaaaatggccattattgccgttgccggaggaactggacagatgggtcgcgccgtcgttgatgctctcatcgcgtctggaaagcacaagacgatcattttgagtcgcaaggttagtatgttaagatcttttatggtcataacaagagttctaagaccttgataggaaaaccccgctctcgaaaaggaacttggggttcccattattgcggttgattacaacaacgtcccagctgttacgaaagctcttgaagataataatgtggatacggtcatatccaccatctttatgatgcctagttttacaggcgatctgcccaaggaggttgaaattattcgcgcagcgaacgcctccaagacaaccaagagaatgatctccagcgatttttctttcgatctcaagcccgagtacgtcctttcattctcgacgctgagagctttctaactaactctataaagacatgtcgctgctggattcccggccaccccctttaaaaaagcggccgaagctgaattggtggcttctaaaaacctcgtatcaacccgcatcatgatgggtcacttcatggactactggggcgttccaggattcacatcccactttgcccccatggccacctttattgacattgagaataattatgctgccatcccaggcagcggcaacggacgtgtcactatggctcacagcaccgatgtagccaaatttatcgttgcgagtttggacttgcaaaaatgggatccaattcattacatcattggcgatactgttacaagcaacgaccttctcgccctcgctgagaaagccaagggtaagtctaaatcggtctttcgtatccgtttcatcgaaggcaatgctaatagatgaccaaaggacgcaaatttacagttgttcatgatagcgtcgacgatctcaagtctggagttattacagctcttcctggtcagattgcagcatacgactttatgccgaagcaagtctttgatatggtcatgccaattcttgggctgtggtttgacgagggcgcattcgacttggagaatgtcccaacaactttgaacgacaagttccctgaaatcgagacgatcaaggccaaggatatgatagaacaggcatggaagaagtcttagaaggtcttcgcgggactgcactctactttgcaatactgtcaaggcgatatgtgatgtaaaggtatcatctccattgtatatcagttccacaactagctcaccgttctaaacacattgaccttcgagtgatgaaacattcgacctgatctgggtgtgatataggctaaagaatgtaaattttctgtaggctttaactgtaggaggcgtaaatactggaaaacctctcttgtggtctaaactaggttttgcctatatttctgtcaaaagactgatatcttctacaatggaaacatgatagatttcccaaaattgtctctttggcagatgtatcaaggtgaccgagcaagctttgcagtccctcatgtccaatacatactataagagaacgagtcacattctcagaattaaattattaattccaacttttggacttaggattgagcttgcttcccgtttgttcttcacataagtttgtaggcattttaggtaggtactttgatgaactctcacgtgatcaagcacgtgattatactcaccacctgaattccatgtgcctctggccccttgctatcttcattcttcacatttatcttcagttctaactaaatttgacactacaccatgagggtgtctaaatcatttaggcaagttgatagaagctacaaggtaatctctagtcttccactcgcggttggagatttgctaagctctcaatcctagagcgcgatcgaattgctcaatagccgtcgccgttcgcaacgaccagacgccaatttgaagaccaaaggggacggtattcagcatggcacgaatacacctccgactcccggcttaaagggcaccccgagcattgttgggatggaagattggttattgaaaattggccactcggtatgattcatgaatatcccactagaactacatgccagaggaatttacctttgctaaatactcgtagccgacagccattgacaagctcaatgtgattcacgtggcagggacgaaagggaaaggaagcacctgtgcattcacggagtcatttctacgcacctttggggaaagaacaggttttcccaagaaaacaggactctacacttccccccatctgatgttccctgaagagcgtatccgtatcaacttccagccccttgggcgagattttttcgcaaaatacttttttgaagtatgggatgcactttcatcaaattcgcgcgctaacacgaatatccctcgtactcttcaactcttcgcactcatggcattccacgtctttatcagagaaggggtggaggctgccattatcgagacgcaccatggaggcgagtatgacgctacaaacttcatacaaaaccctgtcgtaacagccattactacccttggaatggaccacgttaaacaactggggccaactctgggcaacattgcatggcacaaagccggtattatgaagcgtggcgccccgctgatttctgccccgcaggagtctgcggcggtagatgtgattcgagcgcgggcgtcggaaaagggggttgatgtatattttgcagattcaagcccggagctcccatcagaagccgtgcagttggggctagatgtccagcgaacgaacagctcggttgctttagtcgctgctcgtcggtttttagaagctaaggcccccaaaaatactctgccactggccgcctctgatatcaagagtgctattgaacagttctcttggcctggccgtttccagtatcttcaacagggaccctaccgttggtacttagacggcgcacacaacgagatgagtgttgataaagcagcagagtggtatattcagggctcaagtagttccaagtaagcaccctccagacgtgacaggcttcacccgtttcgcaattaacacatggcaggccgtctactcatgtactcatcttcagccaggcatccgaagcgagaaatgccaccgaagttctagatcagcttgccacagcacttcacgacgtaacaattgaccacgtcatttttacgacctactcaccagatcaggaccttgatgctggatcaggtaggccaatcactgcttctagactggcccctttgctaattattaatctacagccccggtctcaaagccttggcacggtgacaagtgccagtcgtttgaggagatctggaagaagatccacggtacgacgaaagtgcactatgaacctgatgttccaactgcattaaacgtggccaggcagatcggtgccaaatctgaagcggtgcatactctcatcacgggaagtcagtacttggtgggggctgccttgtacactctccagaattgagcgtttatcaaatagagacaacacttggacctgttggagagagctacgtggtacgaatagtcgatggtccggtgtcgtaaaatgggccgttgggctccgatgggtcttcctacggtgactttccagccagtcatggctcaggtatatctcttcaagattgtggcgaatgaaaatcggcctaacagttcgagaagtgtaatgtatataatttgggcagacaattgttatcaggccgctgttttgaggtagatggcgattgtatgagtaactcacctcacccactgtgtccctcaaacttctcaacaacatgtcgttccaatacatgcctttgcctggagaccaggaggggagtattcggttgataaatcttctacctaagaaggagcatcctaaaagttgtgagggccctgacaatagcgatgctatgacgccgccgcagcgagtgcattgcaccctctccgtcgctaggttggaagagccaccgccatacgctgccctgtcatatacatgggggatcttagatcgaaaaagcaccatcatggtcaatggaatgccattcctagccgcagaaaatctagaaagcgctctgtatcatctcaccccacatgactatccccttgttctttgggtagacgcgatttgcatcgaccaaaacaatgagggcgaacgtccgcaacagcttcagaaaatgcgacagatttacagccgtgcgacatctgtcacggcttggttaggtccgcctagagataatagtgatattgcactgggctggatccagtattacgggtcattagccgatagccttggtatcggcaccaggcctgatcttatgttgctctcactcttgcagtcactcagattgagcccggggaaactgcctgagaacaaccgcctgaagacatttttgaaagagatctccaaagaagtaacatcggattccggtcaggcagaaagcattagggtatctctggcgaagttatttgaccggccctactggagccgggtttgggctgttcaagagatggcacatgccaagtctgttcgatttgcttgtggcgataagtccgtgtctgtggatgccctccatcatgcgcttagactcgtgagaaatctgaggcagttccaaaaactaaggcagggctgttgtgtacagcaagccacagtcaagtccataggatttcccaccaatacacgcaatgccatcagtctcttaaagattcagagagctgctgagccccttccactcatctatcttcttcggactttccggttcttcaaagccagtgatccgcgcgaccgactgctagcacttctgggattcgcatcggatgctgatatcttgggactttcctctgatttccaggataagtcttatgaggagttgtactgcgatgtcgttgttggccttataacaaatggattctttgatgtgctatcactctgcgaccctgacaatcgaatctcgggatatccatcgtggacaccggattttactaagttgcgagctcgggttcctttgcagcaaagagcattggatcggcatagctcccttgtcaagaccagtctccggccaacgttctcagcctctggcaaaagaaagttaggaagcaagggctgtccattacctgtttcttcaggttcacacctcgtacttcacgccaagctgatcgatatcgtggatcaggttggtacacaatggaaagcgggatattcctgtcggtggttagaggagcttaggcagttttacttccctaatggcgcgaagtctctcgatcctctacctcctacatgcttacaggccgttctacgtacggcagtcgctgatcaagaggggtggcgcgcagccgttaagcctagactgagtgattcgatggtagcgaaagtccaagaagtattggagaagtcggatcttcccgacgataccgcaaccctcacttcattcggcgtcgatgactacatggaccagttacaagacattgccaaatataggtgcccattccgaacatccacaggccggattgggattggccctcaccagatgaagtctggtgaccggatccatgtactcgcgggggcgtcggttccctacgcgatgcgtgaggggacggatcgaaagttgaggctccttggggaagtgtatttgcatgggattatggacggcgaggcacttgataatgtcaaatcactggataagattaagttatattaagacatcatacgctatactctattaaccaatttgaatcgctccatagatcttccagattacgcttgagtgttccgaattattagatgtcatgctgcgactagatgaaaggactacataagaacagggttcatcataagctacgaagtaaccgtatattccgcaatcgtgatccgtttccaagacgttgcttacaaagtagacacaaagtttaattctgtagacctactgagtactcaactgcagcttcgcttctggcaacccatcggcggtagctgtcacctcaatagcccccggggagcctgcggttccgccgataattgccagtgccaatccacccaccacctttcgttcctttgaaggaaaagcgacatagtctgattgccatccattatcggttgccaaaatttcaccggaccctgaaattccaaacgtcacagtgacatcagcatcacggaccacatccccgttgtcgtccaccacttcgacagtcacgaacgaaaggtcctttccatcggcggaaaacgactttctgtcggcacttagtctcaaacttgctgcttgccctgtcgttcgtacggtatccgtagcccactcttcaccgtctttgtaggcaacaaccctcacctcgccgggagcgtagacaacgtcatcccatcggatacgatactcatactcgcccttctttttccggcccagggattcattattcaagaatagctcagcctcgtcaccagaggtgaagacatggacgggggtaaccaggccctcccgatcaggccagttccagtgtgggaggatatgagccatggcatgctctggtctccagtgggcctggtagagatagaaacgatccttcttgaatccagcaagatccacaataccaaagtaagaactgcgagatcccgtatccccgttgggctttgaatcgtagggcgtcggttctccaatgtagtcaaaccctgtccagacgaattctcccgcaacatagtcatatttatctaaaacggagaagaccttgtcagcggatgagccccagtcgacagagtatagctcataggcattgacttccaaagtagatgaattccctccggctccggcagaatcgttcgtaggagaactgttgacatctacgataggaaacaagtaggaatctcttgagctgatggcggaggcagactcagcactgagtagcagcttttcagggaacgccttgtggaactcagggtgttgcggatatatcggagaaccaagatgtgaatatgcaggagtgtcgtatctaccctctccctgatagttcagcgcgataacgtcaacaagttttgagacggcatgatacggcttagcactgttcttggctatggtgaatggtctagtcgcgtcttcctctcgaacaatctcgcccagctcggtcagaatgggggttgactcgtcgtcgtgggtttgttcgccaacttcgtttccgacgctccaaatgatcacagatgggtgatttcgatctctgcggagaagagtacggaggtctgcctcatgccagtcattgaagagaaggtggtaatcgaggctcttcttggaacggagccatacgtcgaatatctcgtcgatgaccaggaagcccaacctgtcagcaagctgcaaaagctccggcgcgggaggattgtgagacatcctcacggcatttgtgccaaaatcacgaagaatttccaattggcgctctgcagctcgtagattgaaagccgctcccagagcccccagatcatggtgctgatctacaccccgaagatgaagtctctcgccattaacaagaaggccctctccatttccaataacggttcgaatgccgaattctgtttcgtaggaatcaatctctctcccagactctaccagccttgtcacggcgaggtacaaatttggagactgcgtcggcggtggcccccatagctgcggctgaaggacctcagtcttgcctgtaattgattccttggaatttgattgaaccgtaacagttgtcttttcgaatgaggctacaggctttcctcgtttctcggagcttgcatcaaactcgtagatatcagtaataatatcaatctttctctccttggtatccttgttttccacttgtacggtcagattgacagtcgcagtttgctggtcttcgaacacttcggtcgtaatttgggtgccccagtgagctacatggataggactggtttttgtcaaccagacattacggtatatgccacccccggaataccatcgtgatgatgatggaggattttcaactcggatggcgatttgattttcctcacccgcggatatttgagatgtgatgtccgttctatacgaggtataaccatatggccacccgccaaggagctttccgttaatccagactgttgagtacgacattgcaccgtctatgtcgaggtaaaaacgcgcgttcttctcagatgaatccacagtcagctttcggcggtaccaggccacgccctgggtcggaagacggcccattccagcatcaatgggggtttctttatctgtgtaaaatggccccttgatagcccaatcatgtgggagtgttatggactcccaatcattatcatcgtaagatgcatccttgtagggtacgtttgtgttgggttgctggtcaggaatttcatgatgcttgctctcatccgcaatgaattcattgaccgaaggtagaacccaatccttcagaagtgtttcgccgccttcgttccagcttgaacggtcctcgtaagcgaggccatcaggaattgactcggagcgccagaacttccagtcttgattcaaagaaatgcgctgccggctgatagagtcgacctcccgagggatggtgcgagcttcgacgttaacattcgaagcctgaagaagaacacacccccatgatagtttccgaaggacttgtgaaagattcatcgtagcagattattcatcgcatagcgagaatgaatgaccgtactaacctttgctatcttggagaacgaacaagacagctaccttttgtaggctgcgtttcgtcacatcactatttcggataaatggggaactgatgtccgtggaaacagcctcaaacccgggaaaagcgttattcagagatgcgccattgattggagcggaagtacggactagaaagtttaagaagctttccccactgatgaatcaaggcagatcagttaattcattaaagtaatgtaccgagagcccgaagtggcatgaacaccaacttattgacgatatctgctagctttttttctaagaacaagttatgaacgagcttgattgtagataaaacatcacgatcattctaatcaatgtagatagtccaaaagttatatttagcaaggtgcattttacggatgcagtcgacatctcacgtgggaataaatatcttctaccctgagcattggagcgaggagcgagcaattgtgtggtcacaatccttctgagcgccgaagatccgggaaagcaaatgacgttgaccctttaccaaatccactctattcaataagaccttcctcatctagtagtgatgggatgcggacgggataaagttgcatcggacagcgactccgcatcgggcgagagatagtccgggcaccagatgatgcaattacaatctcaagaagacgttaatatggatgaattgatcataataaggcaatgaggagaaggccgtcgatcatccattaacaattgctaatcttttgcggatatgagtcagggataattgccggcggtggcacatatacggaattccatcgaagtctaacgtcacagaatcctattagggacattcttactcggttactctcaagcgtcacagttaatagcttctatgaaattgattcttatcactactcatcccattgtctttttagcttttatgataggcaagatgatatagcattaatcaacggtgtttcgtaggacttacccatgtttttgggctcgtaagtttcttaaccgatataaagactggtcaggtagaagacctggattatgggtttataccgtagtgccagagttctagtaagtcccagaagagctcccatgataaaacatattcaaacactagatcgcatcaagaagccatcgcctacgaaaggtccaaggtgctgattaccgccttaatttgtttccgcccttgacaatagttagccttttgcgtgaaccttgtgtccaattatcaaaatctctggatgtagtggactattttgtgctgctctgatctattaagcttctcctgggtcaagccttgatttatggtaacaccttgaccatcatgacgaagtatatcaggtattgcacgataacaatggttatgctgtcgatgcgcaaatgtctcggttgaaagatcgccggaggtgtgtcaaactgggtcaaattggggcgacgccgaaatcaggatcttggtttataataagttgctaccctggtcaaccgaacacccagatgaaaatagcgatagattcaaaaatcaacacaacaacgtcaattcaatgaattttaatacgagaagctattcaatttgctactggaagcagagctcttcaaagatataattttctaattcctctagtacctctatctcatccgggattatattatattataccgcttgtttaactagctgtttaactattaagaacttattattcagattaggaagtaatcgggtttatttttttagccttagtatcttattttacctctctaattatataatttttactatattaagtaatatctttacttattatttattaagacccttataaatcttccggaatagtagtcttatcagtagattaataaccttattattaataaaattataaataatcttctggatctggtaactgcccttagatattaaaatatctggtttataataatatttatactttatcctggcccttagaggaattaaaggaggtattgttgaatttgggagattatagccactataagttagtggggtcagatcgctgttagcgatcctgaccactagctgctagcgattacaaccactagcttatagcggttgcaactactagcctctagcgattgcagccactggctacaatcgctaataaccccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgaccgctacggcctagcgggccctaggaaccctcaggggtccgggccaccagcagagctattattagtttatcgggcttatctagcccagataagggtctagaaaatccgggaaaaatcctaggatattctcagacttttaatataatacttaagaaataaaaataactagaagttatatagtataaaaaagtaatccgaatggtggtatgatccgtatagtggtggatcatattaatagctagattaaataatataataactagagatatagaaactataagaaaattaagtagaaagtattagaactagtaataaatagtaataataatataaatactactaaattatacctctaataatactagtattaagaggaagaactataatatatatataaagaagaagtactttctctaactaataatagagaaagtagtaatttagaggagttaaaaataatttttactaataaaaagaaataaaatataatatataaagaactaattatactagtactaataaataaagttaaaaaataaataaagaaattctaataatatttatctaaaagtataatataactaaataccttagaagaacttcttttttatatactaataaatataaactaatataaataattaaaagaataagttaattagataaaaaataatctaaactatctataatagagctatagtatagtataatattaataatagattaaagaaccctagaagtaatagaagttagaagctctatttatatccttatagaaatagagattaaaaggaactagtttataatatttattaattataaaatataagaaaattatatcttactagtagtaattaactaactctatttactatagaaaaaaaagaaagaaatctatatagtaactaatataaaaggcttaaaatttaaatataataatagaattattaacttagaaactaattatcttataattaaaatctaagaaaaaaaatttaatattacttataacttagtattattagaaagttataatattatattagagctattatagctataaaatataaacttattaattaattagtatactagctatatagagtaatagtatttttctaaatatctaaattaaaattaatagaaattaaaattttattagatattagaaaaatatatttattttttaatatctaatattagattatagtagatctatataagtagatagctattcttaagatatagcttttcttctaattagtctctattctttataaatacttatagtagtactagatagactatatattaaagtaatagactaagtagatatagctactagatttataatattaaaagtagctttattattataaatagatctttaattaattagaagaatatataataaatataattagtaaatagctatattagattatcttagataataattattattactttaagggttttattagaaatattaactagatcttaagaaattagaatatttatattagatattatagctataaatacttactagatatttagtaattaattaattaaataattagtactttaaattagaaaggaaaagtagttattactattaaataataagtttcctctcttaggggctatagctatagctagattatttatatatatatagctgtataaatagcttctattattagagtttttaaggtattaatacctgtgccgaggctgaaagtatatttatttaacctttattctgtagaaggtctaggtatagaccgctaaccatgtatataaaaaaaaccctatataatagataaattacatgttatgcctaatcttaggataaccttgcttatagctaaaaaaaaaactaaaaaaaattaatttatttattagtatatagaagagaaattcttctaagatatttaattattttttctttctattagttttactataaataaagatatatcctaagatcagataatatataatttaatatatattttttaagaatataattagtagtttatatctgaacttttaatactataagataaagttaaatattatacttttagtctggatatagatattaatattttaaaactctaataataggagctatttatatagctagatatataaataatttaataatagctatagctcttaaaaggggaagcttattatctaatagtaataactactttttctttctaacttaaagcttattactaattatttaataaattaattactagatatttaataagtaaattataatatttaatataaatattctattattatatagtataaataactatatataaatagatatcagattaatattaaatctatattatttctaataaaaaccttttataatagtaaatatatactatatttatagaggtaaattaactaataactttatataactaacttttcttatttctaaataagtataattttaaattaaattaaaataaactctaatattaggctgcttcttccactacgcctttcgaaacgatcccttcagtattccttagcctaccctataggctgaacctaccctagacccagcttaccctacagctggtctaccctatgctggaggccttgacctttcaaaacttactactttaattaacttaaaaaagagatttagaagaaactttataaaaagaataagttagtaagtatttataactatataactatagttataagaattaataactagtaatactaatagtaaatatataaatagtaaataaactattatactaatactagtaagctataataataataaactataatatctaaaatatatatagattctatagagctagaagctatagaaaaatataaatattataactataataagattaaatatatcttactataatatctaaagctaaaaagatagaagaattagaaacctactaaggaaagtaagaaatagctagaagtaattagaaaaactaaaactaaatataatagttagataacttatactgaacagggtctagagtaggttagggttaaactaattagagtattattctaagtaatataatcagattattataaactatataatataagttactattaatatataagtattatagagctagtaataatagatatatagataattatagtatattaataactatctgaaagagtattctatctaataaaatagatatatatatataataagtttattacctatttattacttacttattacttattctagataataggttaatacctattagtctaagctctaagtaggcctatactttatatataactttatacagcctaatagagatctttatttataatataatactctctccctattagttttattcctaagactagattacttattctatactagtttagtatatacttagttccttatttattttattatatatcctactaataagatatctagttatatttctaaataaaagaaatctaacttagtatataaatatacttaaaagtctaagtatattcttatctatagttttaaagttattccttatacctagtatatagataaagatattaggtattttattattctaagcttaaattactatataatatatatttatataggctatttatataataatacttattctttaatatctttaagtaagtatttttattctttattttttttatttattaatctttttttctaattaagaaaattaactaagagttattatatttagagaataaggaaagtaatatagaggacttatttcttaagagatagtattagattaataaggctcttatataaatttccaggttatactaaatacagaagcagctttataagaagggtatagagatactaaagaaggggctaaataatataaaagagttagaagaggtaaaatagaaaaaagcagaggaaagaagttattaggaagaattagaataagtataagcttaggaagttaaacttatattctaagtctaattcttatatactttataaatagttaatttttctagttttacttttaattcttctatagaggatctttttagtagaattacttaaagtagtattactaatccttctttttttaatagaactagtagattaaatattagtatttctttaggtatttaactagttcctatatattattatttttattatagtttttctattttattaaataaaagatttatttatttctaatttttttttttagaatcttctctagtttatattcttttttatagatcttaattagataatcttaatctagggtattttctagtatttttttaagtaataagatataaaaaactagatatatatatattatatctagtagtaaaagtttataattagtatttaattttttctttaaaattttaaataatctaagttttttataatttaatttattatttagtcttattattataatatttttataaagtagatagattttatctttcttctttaaaattagttcctttaattttattttattatagtatttttttattctcttctagagaaattctagttctatttttattttagtatataataagtataaagtttcttttataagtatagtagctaatatatctagtttattaagttctagttaattctagaatttagatttatagctatagtttatatatattagtaataattagattaattcttatactaagctattatatataatctatactactagtaatagttatatctaattattttatttatagttgttgaaattacagtggccttcaaggtgtattgggccttgagaccgctataacgcagcagggaagctattaaggctataactactatatctacttattattataagttattattattttttatagtagtactttcagatattaaaaagtaaatatatttttctagtatctaataaaattttaatttctattaattctaatttagatacttaggagaatattattactctatatagctagtatactagttaatcagtaggtttatatcctatagctatagtagctctaatataatattataacctcctagtagtactaagttatatataatattaaatttttttccttagattttaattataagataattaatctctaagttaataattttattattatatttaaattttaagccttctatattagctactatatagatttctttcttctttctctatagtaaatagagttagttaattactactagtaagatataattttcctatactctatagttaataaatactataagctagttccccttaatctctatttctataagaatatatatagagcttctagcttctattactcctagggttctctaatctattattaatattatattatactatagccctattataaatagtttagattattttttatctaattaatttattccttaagtatactatacttattattatattttaatatctatttcaggagttcttttagtatcttaggtatatctatatattctaggatatagtattagaaccttcttagctatttactatacttattctattcctcaggagatatagtttctttataagagtagcctgcagtttattcttatttatctatagagataattactagttccttatcagattccttatcttctattaataatattattatagcttattcttaatactagtattctatttcttcctaagcttagtattatttaagtatttatttagtaagattcttattattatctttattccttactagattaaatactagttacttagtatatagataattaagatacttttaattataatattatttaatataccctctatagttataagtagcttaatctttttaggttttttatttatactatagtttaatttttttatccttatagatcttatattactattctttatatatcttagctagtatcttattagttttatattccttagggtattttataagatcctatttaaagatagaatactaattaatattagatagcttatttataaagtataatattttcttactaatatacctaggtagtatatttttatatagctataggaaggtattatttctaaccttctattactaatagatagtatagaaaatattataatatattaattataattctttataatacttagttcttaagatatttttctagcttccgagtaacttatataagctatttagatattagatagtatttatagttctttacctatagactataagtacctctactatagctaggtcctacttcttaattttttattagtaataggtatagacttccttatattcttcttatattatattttttacctatatatattatttttcttcttctggagtatatttaataaactaattattatatctaaatactatcttataggttataagtagtttatatttagagtctatttactcctccttatatttctttttaaggtttttaaatatctttttaatttatttttagttttctattactatcttattatcctaatccttagaatcttctagtattttatagaagggtagtatatatattttagaaaattcagaaacttttatactatctggagttccttcctaagtagtcctcctaactattctaagagtcttaatctcagtttttccagttacttctaactatttccttcccttcttagtaggtttctagtttttctactttttaggttttaaatattaagataagatatatctgattttattatagttatagtatttatatttctttatagcttctagctctataggacctatatatatcccagagactatagtttattattattatagccttctagtattagtatagtagtttatttactatttatatatttactactagtattactaattattaattcttatagctatagttataaaattataaatacttattagtctatcttccttatagagttcttcctagacttctttcttaaattagttaaagtagtaagatatagtatatttatagttctaactagtcctagctaaaagttaaagatatttagtactaaagactaatactaacccagtttaaataagtagattaatcttatactctgccttatactttttatcttatattccgaaggtttagtaaaggatttctataaagtaattaaagtttattataatacttatagtttattagcttctatatttactaaggtattcccttataataggtttaaaccagttaagagtactccccttaagttataagtaggtatatataacttacctcttattagtattaagagtaatagggaaatagttaaagtatacttatagttaagttataaatccctaaagtttagcttatattctattaaatatctcagatactagtagcttaagtagtatccctagctctcgcctattagctatagtctaggcctaagtctgtagattagtattctaagtagcttactatcctattaggttagttatagttactatctcctactatatagttataagatactcctaaagttagagaacttattccctaaggagtttaacttcagtattattattactactactactactattactattattcttatttattatattattatatagaacagatagattattagtagtagtagaagtatactactaagcttatagaactataacagttataatattttctctattattatataataattaaaataaggtaattagctaaataagagttattaatatataatagttagataacttatactgaataggggtctagggtaagttaggattaaactaattagagtattattctgagtagtataatcaggttattataggctatataatataagttactattaatatataagtattatannnnnnnnnnnnnnnnnnnnnnnnnnnnnnnnnnnnnnnnnnnnnnnaaagagtattctatctaataaaataaatatatatatatactaggggcttataatagcttactagtaatccagagtaagtttagctagggattattcagacttactaataatccgaagtaatctatccctattagtagaaaagatagggtatactatataatatagtaagtatatactttatttataatatagatacagcctatagggtagactaagaaatactaaaaggattattttaaaaggtatagtagaagaggtagcttacttagtagggaaaaagactttattagctacagggtagctaagaaagatagactatagggtagataaaagagtaaattagtagcttaaagaacctctatctagtagggaggaagccctatacttataggtattttagagctctaagagctctaaagataatatattactttctataatataagcttataactactataaggttcttatataatagatataaggtctgctaatataagtactatagtagatataaggtttactaatatagctattatagtagttataaggtttactaactaaatactaaggttcttatatagtagatataaggtctactaatataagtactatagtagatatttttaaaaggttaaagcctctagtatagagtaaactagctgtaggataagctgggtctagggtaggtacagcctatagggtaggctaaggaatactaaagggattgttttaaaaggtatagtagaagaaatagcctacttagtaggaaaaagaggctttattagctacagggtagttaagaaagatagactatagggtagataaaagagtaaattagtagcttaaagaacctctatctagcagggagaaagctctgtacttataggtattttagagctctaagagctctaaagataatatattaccttctataatacagacttataactactataaggttcttatatagcagatataaggtctattaatataagcgctatagcagatataaggtctgctaatacagctgctatagtagttataaggtttactaactaagtactaaggttcttatatagcagatataaggtccgctaatataagtactacagcggatataaggactactaatataaatactacagcagatataaggactgctaatatagctgctacagtggatataaggactgctaatacagctgctatagtataatacgagatcgctaatacagttactacagtagctgttacagcggttataactgctaatataattaccctaacaggcagctatagcaggttaagccagtagctccagagagcttccagctttaaaaagccctaaattagttattttattccttcttaccctatactaatctgatattatttaattaactagtatagggtaatctaatctaccctatagactatagggtaaatcttaataccccttctaaaggaaataactaagttagatccttagagtactctttcaggcctagtagatctctaaaggcctgctgaagaggtatagttagtagcttagttagtctgtcagtaggtatagccttagtttccagatagctaaggcttactaaactctctgtaatttaaaccctattatagtagaactttagtagtatatacttagttctaatatatagggtagggttattatttatagctatatagccctggttattatagtagatagttataggggtcttcaggggctggtttagctccttatagagcccttttagctactatagttctctaagagcctctataaggctatctgcttcagcctctatagtagatagagctatagtagttactttcttagctttccaactgatagggcctccagctagcttaaagagatacctatagatagatttactagtggttttatcccctgtaaaatcactattacaatagccttccaggggcttattttataagtaacttatagcgaggtttttagtaccctttaggtactaaagtagcttcttagtagcctttaggtagattttatagagcctgtatatagcctgggctaactactaaactgaaaaggctatatcaggcctggtttaaagtattaggtatattaaagtccctataatctgctgaaatagcctgtattccagggggttacagagacctatagcctctatagcttccgctgtaagtcttataagattaggctgtaagggtactaacagaggcttctctttagtaatcttaaaggcctatagtacctgtttaatatactgaggctgagagagatacagggctttcttaagcctatctcagtaaatttaaacccctaagaagaaggctgtagatcccttatcttctatagggtaaacctaataaatttccttctttagcttattaatatagctaatatcagggcttattataaggtagttatctatataaattactataaagatagcctttttagtattatagaagactgccgggtctaagattaggaggctaaagcccagagactttagcagggctttcagagcctcttgctactctctaggggactgcttcaggctgtacagggcttttagcaataggatagcttgctcttcagaagggttatagccctgagacttagctatagcgagtaattcagggtttttcttcagtagctccttcaggccttcagggagctttatatagagccttttagtaagtttactgtttaaaaaggtatctataaagtcgatctgcttaatattatagttatatatagctactagagctaatagtagcctccaggtcagaggaatagctatagaaataaaagtcttattataatctaggccttctacctgtaagaaccctctaataataagcctagctttatattttagtagtttattataggggttaagctttagttttagtatatacctgcagcttagggctctatagcccttaggtagatcttttagtactataaaggagaaggtactagtatatattagctactcgagtttactaaagatagtctatagctaaggctctctttcttttagcagtagctttagcacctctttccagttattaggctctagtgagagcctagctttagtatatattatagcgcttgcttagtatactatagcggtagcctgtacctagttagatagatctattagattatctataggctctgagttaggcctgggcttactggattagtatactgtagttagcggagcttcaggctcttggggttctgaagcaggtactgtagctagcggtgtttcgggctcttatagccctatagctagcggttcaagcgctatagctagcgggttaaaggattcttatagcagctgttgcagcagctcttaagtctcttttatatactctatttcctctatttccccttctaaagagtataagaggagggggttttacagctgtaagccctgttttatagggcctatatcctttaaaatccttagataagaggtcttagtaactagcctcttctcagggatataaatctaatagattttagagcctaagagtactagaattcgctctaagattgttctaggggctaatttatagcccttagcctgctattcagaataaataaagatcttatagtaagctctaatagctctataggcctggaagttaggcttaaagggagtttcaggctctaattcttaaagaaatagctactaagggggtaaatcccagttactaatagtagtatagttaactaactaaataacccctagaaggatataatactagaggtataatagtagcctagactactataaaataactctaagcctatctattagtactcttatagagtacttagttagcttattttactagtaaatataaaggcttaaagtactaaaggtagtacttttagtagctagctaatctactaaatcccttataatttccctgctattataataaaatttagcaggataatagttatagtagttataaaggccctaatagaagccttttatagtagttactataatagacttttccttattaaggaggagaataacctatctatagcaggttttttaatctactaaaataagctctatagaccttctgttatatagtataggcttaagatagaaggtatctctttctatagaatctaaagctctagatagattagggatagctatatatactaaaagcctatagcttttagtactaatatagattaaacagaggaaatctttttttcttatagagttaaaatcagagagatcttctataattttaatagttttctttagtaattaaaactctaaatactctagctatatatactaaatacctactaattatagtaggtctttataggtcttaggtacttatagtaagggcctaataatactaatagttccttatattagggcttctttagtattaaagctagaataatccccttctgaaagcttctgtactaggaccttagtagataccttagcaggctatttagtaggcttagtaagcttactaggctctataaagtctagggccttaggggtctagatagaggtcttagagggaatttaaacctctattaaagtatactatttagtagacttagtaagttctttagcagactatttagtaagtttagtaagcttactaggctctataagatctagagccttaggggtctagctagaggctttagagggaatttaaacctctatagggtagctataactagtataaacagagggctccttaggtattataagcttaggggttttttccccttttagctatagataaaaactatattttttaaagtttaaaagactatagtagattctattacctataaatagctattatcttagaagggtacctcctgaattatagtatcttatcctactaactatattagtctctagggtaaatagaaaaaaagtttcttttagctctaaattcctatagattagagggttctaagagattagaacttaaaatatagtagttctaatatctatagggtaggtcttactagtagctattaggatatagcctatcttagagtactttagggctttatagtccttataataagctctattatttactaagtatactatagagcctatattatatagaagggtatttagcagactatatctctaactactaaagctagtagtaataggagctactataattttaataggtttagagagctaatagatctaaaaggctagctaggggctctctttattactattttctagcgagctttaaaggtcttctagactatagcctagagtaaagctagtaggtttagctagcttttctttagaggctttaggcttaaaccccttctattagatctttcccttaaaggtttttttagagttcggaaacttctttttagtagattttttagtatatctagctctgtaatttatagctttagctactaaagagctcttattatactattcctccagaaggtctactataaggaactataggtttaggggctctaaggagcctctagaggctttaataaccctaaggttattctattagtactcagcctactataggaagtgttgattttagagaggttatagcctctataaattagtggggttttagctgctactagcggttaaaaccactaactgctagcgatcttagccactggctattagtgatcaaattagctgttaaagaccgctattagcggtcccagccactagccgttagcgatcgcagccactagctgctagcgatcgtaaccactagcttctagcgattgcggccactggccacaaccgctaataaccgcccgggaagcagctttagcgggatttagagtagtttttagtcggtagacttatgagagaaattagatagaattttctggtctctctcacaaaaataagattcttttgcgctatattttgcactatattaggtccctctggtactgaaactcactgagtaatagcggagttagcagttgagagctataagttatagcgaacttccctgctgcgttatagcggtctcaaggcccaatacaccttgaaggccactgtaatttcaacatatattaaagaaggcccttatatagtaatattattaagaaagagttcagtaatatcagggataaggtctataagaattcaactgataatccatataaattaggctattaaatttattactccttaagggagtatatatatcctatacagcctaataggtattaagaatatagttaagtccctgcttatcaggttaagagatatttagttataacccgagaaaaagttaataagtaatagaatcttatatattataaagctctataagaagttatttataccagggggaataagagtatccctgattataaattagttaatcttagttactaagttaataaatcttatatctctatctttcttaactataagaaactaagggttcctataggaagtataagactctttaagtacccctttcttaatatagtctctcagaatatctattaccttgctttccaagcctttcaggataggaattaatccggcttactataccttatacttaataactcagataacttaaggtagagctactattagattaatatagctataatccttaaaagtctatactattactttttcttagttataaagtatttaaataaatatttctagctctttttctattaagaagtcctttatttataataaaatagtatctaatcgctcctttataagcctggagcctatcttaatattagagaacttactagtaatctatataggaaaaagatataatatattaagagttaatagagcctcagcttatttcttctcttactaattagtattactattaggtactaaactattggatagaatattatctagggggttaattttcttatactttagtttatatattatatttatactaatatttagtatattagtacctctgctaaggtatttttcaaagtatcttatttcgttcttataagaattactttactcagtagcctgcttatattacttattataagtagataactaagtctttaagattttctagaggataactttagctttattattagagatagggataataatatctccctccttaatttctatacttataattctatctatatcttctaaggagatataaaatatttataatagttccctggggttagaatttacttaattaaatagtttattaagtttttctaccccttggggttctagttcctctagtaatactggatttatactaaattactctcctatattaggagctgtaattattattgttgaaattacagtggccttcaaggtgtattgggccttgagaccgctataacgcagcagggaagttcgctataacnnnnnnnnnnnnnnnnnnnnnnnnnnnnnnnnnnnnnnnnnnnnnnnnnnnnnnnnnnctaatatagtgcaaaatatagcgcaaaagaatcttatttttgtgagagagaccagaaaattatactaatttttctcataggtctaccaactaaaaactactctaaaacccgctaaagctgcttcccgggccacttttgattttccgcaaaattcattaaaagagattctaatagttattactaataactattattatatatataaggatctagttatttataataattaggctctagctataaggaataattatattagagatatttattattactattataagaaatagttagtaataaattataaggagagatagttaatcataataagcttagagagatattataattaattataaataataagtctctatattattaaaaagaactatatataaataaataggtataaaattaaaacttatctctatatagatcttaggaactttactatagtaaatctatactatacttatagaggtaaattaatattaacttctagataactacttttcctatctcgtaataaaaccttatctaatattaaatctaactaattctaaatctaaactctaattaaaattaatagaataaaatagataaagatttaattaattaaataagagctatttttatacagattatcttaatataatatatatatataataaaatagttattagtaagatatagttatagctcttaatttagctaattcttattcctaataatataacagttagataacttatactggatagaggtttagggtaaatcagggttaaactaattagagtattattctgagtagtataatcaggttattataaactatataatataagttactattaatatataagtattatagagctagtaataatagatatatagataattataatattaataactactaagaaagtatttaagctatagaaataaatatatatatatactaatatatttattagagtatttataatagtttttactttagactttactttagtaaagtaaagttaactctattagttcttaaaataaatttactatattatcttatatataacttcctatagctctagaggtagtttttatttataatataatactctctctctattagttttatctctaaagctattttattatactatactattataatatatatttaatcctatatttattttatagttattatttactaataaaatatctaactatatattaaaataaaaaaaatctaagttagtatataattatatctaaagattagaatatattcttatatataggtttaaagtacttctatatttttattatattaagaaggagatattatattttattatactaaatattagttattatataacttattattatttagattacttatataactatttatattctttaatatctttaaataagtatatttatatcttaagctaatatagttactaatttatataattaaaaaaattaataaaaagctattttatcttaagaataaaaagtcctaagctaaaatagtattagctaaggcttttatataagtttcttatttatagtaaatatagaagcagctttataaaaagagtataaaaatactaaaaaaagaattagataatatagaagtattagaaaagaaagaatagaaagagatagaagagagaaattattaggaagatttagagtatatctaagctcaggaagctaaattagtattctagatctaaagtatttatactatagagatagtagattttttagagtttttctttaatttttctataaagaatctctttacttaaaatagtattattaattcttcttcttttagtagaactagtaaattaaatattaatacttttttaaatacttaattagttcctatatattattattctttttataatctttttattttattaaataaaatatttatttatttctaatttctttttttagaattttctctagtttatattcttctttataaatcttaattagataattttaatctaaagtatttctatataataataaagaagatattataactactatagttctataagcttagtagtactatactcctactgctactaataatctacctattctatataataatataatagataaggataatagtaatagtagtagtagtagtaataataatactaaagttaaactccttagggaataagttctctaactttaggagtatcttataactatatagtaggaaatagtaactataattaatttaatagaataataaactatttagaatactaatctataagcttaggtctagattatagctaatagataagagctaggaatactacttaaactattagtatttaagatatttaatagaatataaattaaatttcagggatttataatttaactataagtatattttaactatttctctattactcttaatactaataagaggtaagttatatatatctacttataacttaagggaagtatttttaattagtttaaacctattataagggaatatcttagtagatatagaaattaataaattataaatattataataaactttaattactttatagaaatcttttacaaaatctttagaatataagataagaagtataaagtaaagtataagattaatctatttatttaaactaggttaatattagtctttagtactaaatatctttaacttttagctagaactaattaggattataaatatactatatcttactactttaactaacttaagaaaaaagtctagaaagaactctataaggaagataaattagtaagtatttataattttataactatagctataagaattaataattaataatactaatagtaaatatataaatagtaaggaagctactatattaatactagtagattataataataataaattataatctctagaatatatataggttctatagagctagaagctatagaaaaatataaatattataattataataaaattagatatatcttactataatatctaaagctaagaaagtagaagaattagaaacttactaaggaaaataaaaaatagctagaagtaattagaaaaactaaaactaaaactcttagaataattagaagaattacttagaaaataaaccctataattactatagttcctatatttttcagaatatctactattacctttattaaaatattagaattaggataatactagaattagaatatattataagaaaaataataataaatcttataaatcttttaaaatcttaaataaaaatataagtaagaagaaaatattctagaatatagacctcttactaggtataaatatatattctattatactaataaccttatttagaaaataaataaaaaataagaatagtatatatttactagaagtaaaattaaagctgaatataataaactatatatctattattaaaagaaaatataaaaataaaatctgaaaagagatttagaactaatagtctatagaaaaaatactattaatactatctaatactaagataatagatataatatactaacttatataaagactataggaatattagaatattctactgaattatagataacttattataatatttagtactagatatattagaaagctaagataaaaaataacttttttctatactctaataggaagatacctattaaatttaagaatatttagataatatactttatatattaataatatagaatagaactatatactatctttaaggaagatttagaagaatactctattaaatatatatataaagaactattagtagaaatatatagagaactataatataaggtttataaatctatagtagtaaatatatactatacttatagagataaattaactaataactttatataactaactttttttatttctaaataagtataattttaaattaaactaaaataaactctaatatattaatactaaacttaatctaataagattaatatcctaatctaaatataactaaaaataatctaaagcttaaataattaatttttaaaagctatctctactctaattaacttaatataatatataatatactaaaactataaattatatattagattataataaatctatataaatagataactattcttaagatatagcttttcttctagttagtttctattctttataaatatctataatagtactagatagactatataataaagtaatagactaagtagatatagctactggatttataatattaaaagcagctttattactataagtagatctttaactaattagagagatatataataaatataattagtaaataattatattagattatcttagataatagttattattactttaagaatcttattagaagtattaattaaattctaaaagattagaatatttatattaaatattatagctataaatacttattaaatatctagtaattaattagttaaataattagtactttaagttagaaagaaaagatagttattactattaaataataagctttccctcttaggggctatagctatagctagattatttatatatctagctatataaatagcttctattattagagtttttaaaatattaatatctatatccagactgaaagtataatatttaactttattttataatattaaaggtttagatataaactactaattatattcttaaaaaatatatatcagattatatattatctaatcttagaatatatttttatttatagtaaaactaatagaaaataagtatctctatctctttaaaacctagttttaaatctatagtttaaaaactatatatttatcttatataacctatactataaccttctactagataataactttagaataagtattatatttatataagaacttatagttttttaaaagctttataatctaaaggagtatttatttagagagaaactatataatatatttaatataaagattagaataatactaaatatatataaatcctataatatatagtctagtaaatttaaaactattctcttctaaatccttaaagagaatatatagaacttctagttctaatatattaaagaaaaatatatatttagagaagtatatcttaaactaaaatagtactttaataatactattaataagtagtaatattattataactagatctagattaatattactttaatataaacagatagagagaatagagattttatagtatactaaatattatagaaagtctttataactcttataagggtatagaaaatacttagagataactataagggggataataactttaaaaatactatagtaagagtatataaaagcttaaagaaattagaaatagtactctaaagagagtatataaatactaaagcccttatatatagctttatattagctttagagataagcttattaaaataactagaataaagcttaataactctaagagcctagaatataataaaagatatatacttaattaattagtaatatagatatatttagaaactactaaatagaatataataataatcttattactctataaatataagagaaaaactatttaatagagattttattagctaaaactaaaaactataatatagtaattagagaaaatattattttatttataataagtctagatatcagttaaaaaactacttatagtaaagatctaaagtataatactaatttataactaaattctttaaagtagaaaagaaaatagaaaaaagtaatatactaaaagagtttaaataataggtttagaatctagaaagaattaaaaatcagtttaaaatagtaaactatagaaatcctaataattataatatctaaataagaaaaactagtatataagtaataataagtaataattagtataatatttacttaataaagtattttaatatttactctctaaagagaaaatctagaaaaaactataaaacctattataatttattattaaagaaaaatatataatatagttctagagaattatactagatataaatactttattaatcttaactatagataaactatagtttaaagtattttaataaattaatttattaattaaactagatactatagctaatataaaaagtattaagtttagaaaagaacttatagagttacttagtataatagagctatatactctatttaagcttattatattttatataataaacttagagactccttttctaatatatctttataatataaactatctgaatattaagtttaggaatataactaataaagtaattagaactatagataatctctttattctaattataaaaaaatagagctatatataattcttttctaaatatatactaatagctaatatagcttatttaatagaactagagctaaaataactctattattattttaactatctattagtaaaaaggctatatagacttctagagagagtagattataaatatataaatagagagataataaaaaagattaaatacttctactattaatactaagcttataatttaactctaaaatattttaaatttaaattataagataattttaactttaactataaaattataattaatattatatacttactagattaagagcttattttatatatagtatatatagtaactatatttcttattcctaaataagtataattttagattaaactaaaataaactctgatatactaatactaaacccgatctaataagactaataccctgatctaaatataattaaaaataatataaagtttaaataattaatttttaagggctacctctgctctgattaacttaatacagtatataatatactgaaactataaattatatattaggttatagtaggcctgtataagtagatagctgttcttgagatatagcttttcttctagctagtctctatcctctataagtatctatagtagtactgggtaggctgtataataaagcgatagactaagtagatacagctgctagatctataatattaaaagcagctttattactgtaagcaggccctcgactgaccggaggggtatataataaatatagttagtaaatagctatattagattacctcggataatagttattattactttaagggtctcgttagaagtattaactaggctctgagaggttagaatatttatattagatattatagttataagctttaagttagaaaggaaaggtagttattactattagataataagcttcccctcttaggggcttaagattcttttgcgctatattttgcactatattaggtccctctagcactaaaactcactgagtaataggggagttagcagttaagagctgtaagttatagcgaacttccctgctgcgttatagcggtctcaaggcccaatacaccttgaaggccactgtaatttcaacactacttagaataatactctaattagtttaatctctaacttattctaaactctatctagtataagttatttaattattatatattaataactcttatttagctaattaccttatcttaattactatataataataaagaaaatattataactattctaggaactctagctcaatagaataatactctaaagctactaactatttagtaaataattaaataacttatattatatattaaaagctttaaaagaaaatattagaaaaactaagaagaaattatttatttaattttattagaactattttctaaagatatctagaaactaaatagatttaaaatttaattctaaatctattttaaattttttttaattaaatttaaaaaaaataaaaaaattataagaatatattttattagtataataaaataataattctaagtatttctatataattaatataagaataaaactaaactagaaagaaaagattaaaatatagttaatattcttattagttataataattttattattatatttactagagtctttagtaagataaactataagtaataagctataaagaagtttaaagatttataataaattaatattattttagaatatattataaagtttagggaaattatattttaattagattaaaataatagctcttttaaattagtattctataataaacttaagaataaaattaagaactaactctttaagataaataaactaaataacttaatagaatatatagctataatagtataaattaataactatatctataaataaaagtaataaaagggaaataaatagaatagttagaactatattaaagctagctataaatctaataaaggagtataataagttctattactatctatagagttcagaatatatttagagcttatagagctagaaactataaagaaatataaatactataattataataaaattagatatatcttactataatactctaaatctaaaaagtagaaataatagaaacttactaaagaaagtaaaaaataattaagagtaattaaaaaaattaaaattaaaatacttagtataattagaaagattatttagaaagaaaaccctatatttactatagtttctatattttctagaatacttactactacttttactaaaatattagaactagagtaatattagaactaaagtatattataagaaaaataatagtaattttactttattttatctatattttatttaattagatagtatattctaagaaattaattttttatatatagaaattttttttttaaattctataaaaagattagttttttatagtttttctaagattttatatatatatttcttatatatctttagattattagaataaattagaataatattaaaatagataattataaaaatattaaaatacttctaaagtatttaattatttatttattagaatattataaatatatttattaatttaaaaaatataataaaatatttataaaaattaaactttattttaaatactattttctatttattattactagatataatatatatttatctagttttttatattttattatttaaaaaagtattagaaaatattctaaattaagattatctaattaagatttataaagaagaatttaaattagaaaaaatcctaaagaaagaaattagaaataaataaatattctacttaattaaatagaaagaatatataaataataataatatttagagacttattaagtatttaaagaattattaaaagcttatttagtaatattactagaactagaaatatctattctaataaactaaaaggagaatagttttatacttttctaaaaaaatattagattaattttaatctctaaaaatataaacttagataaaaatataattaaaaataaaatctatttttaaactatttcctctactttcttttacttaatatactctaatttctctatactattaatactataaaatactatttatattattttatctaactataatttcttttattaataaagatattagatttttatatctatataataatactccttctattggaaggcttttctaaagtatatatttatagatagataggtgtaaaagttattaattaagttactatcctagctatagagttaggctggttataaagctagttccagagtagttgtaactaagtatattactctataacaggcttccaggctgtaactgctagtaggaggtgttgaaattacagtggccttcaaggtgtattgggccttgagaccgctataaagcagcagggaagttcgctataacttacagctctcaactgctaactccgctattactcagtgagttttagtnntagagggacctaatatagtgcaaaatatagcgcaaaagaatcttatttttgtgagagagaccagaaaattctatctaatttctcttacctatagctttataaaagcctaagttaggcttagaatttttagaaggttctaattccttataaaataactcatagggtgttaactctttattagagatagcagttaaattaactagctttactatagcttttataataaaacaccagagatatataggaatattggcccataaaatagaggctcttaacctttctaagattagtctaatagatctttctataagtccattttgactatgaatataaggattagaggttgaaaaagctatcccttttttatctagccaatctcttagtttggaatcaacttctaagcctctgtcgaagtgaaacttcttaggatatctattatattgatttttaaagcttttaaatagattctttatagctaggctaatagttatagcttctttattagctagactaataacccagcggtatctagtttttctatcaactagaaagagattatagggctttttattatagggtataggttttattttaactgtatctccctctattatatctagtacagagactgggtcttctataggttttctagatataaccctaatagctttagctcttatacaagctaagcaggtaaagtctttttctttaactaaggaaaaattaggaattcctttagttataatagctgttttcttaagcaaggctaaccctaagtggcctagtcttatatgccagagaccagctagatctaataatttcttatattcttctgaagttaagcttatagctttctttttagaaaaattagaaggaacatttttttttactttttattatatagctagctaaggtatagataatagtaactctaaaaactctaagaaaagcttattaagtatataatttagctataagccctaaaggggaatacttattatctataattaactataatatctttctaagcttattattactaactatctctccttataacttattactaattaccttttataatagtaataatagatatctctaatataattatcccctatagctagagcctgattattataaataactaggtccttatatatataatagtagttattagtaataactactaggatctctttttagatattaattatttaagcctgtactctattataagcttacttatagtaataaagctactctcttatatataggcctagtagttatacctactaggactattactctatcttatagctagtaagagtatagagatagacctgatctttaataatatacttacggagaactataataatattcctctagtacttaataattattataacctaaagtactatatatagtaccagtaggtaatatactagcttaagttaatccagactgagatagctctttaagttaaataaataaatatctattttaattagtattattaggcagaagagaattaaatagaatagaattattagaaagaacttccctgctgcgttatagcggtctcaaggcccaatacaccttgaaggccactgtaatttgaacaaatattaattatttaaatctatattctattataggcttacttatagtaataaagctgctctcttatatataggcctagtagttatacctattaggactattactctatcttatagctagtaagagtatagagatagacctaatctttaataatatacttatagaggactataataatattcctctagtacttaataattattataacctaaggtactatatataatactagtagataatatactagcttaagttaatccgggctaaagtagctctttaaattaaataaatatctattttatttagtattattaggtagaagatattgaatttgagagattatagccactataagttagtggggtcagatcgctgttagcgatcctgaccactaaggtaatgtgagggggttgtggggccgaaatggcaacattgcagtgttttttgctgcataccgccctacccgccggctctcaacttgagacgtaaagggggcgcgtaacaggggtagatggggctatgcccaccacagaagcgtttcacaaatgacagccagcggcgaagcaacgcatttattctggcccagaatattccatccaatagcgtcaagaaagccgttggtcaaacgctgcccaaatcgatttagactactctcgtacgatcgcccgccacggctccttttctgagcccgttcctgcgtgtgttcattggctttttatttcgtgtgccaaaattaacattaattttacgcaccgtctcaaattcggtgaggcagtctggatgggattgtgattggagggaagaacagattcgtctttttgccttgaaatttcccaaggatgccgatctggaaggacttttgatatctaaacgtagaaagctccgaccaactcaagcattgaagaacaggggcgaggataagctaacaacttgctcctgttgatcacttcttcattacgtcaggcctcttctccacgtcgtaccataaggaatgcgagatcacttatctcctcgcacgagcaccgcccagctgcctaaacacgataatgcttagcagatcgcacagctatcagccggctgcttcaacatgacagtgctcaccaggtggtgcgtatatccctcaactgcctaatagtactaatgatagacgtgaactcaaacgttcgctttcaaaagtgccgccaaattatctacctcggccacagatacgctcagacatgtgagccatacgcaaggtctcctggtattgtgtagattatgcttgtttgtttggcgctatcaacgtccgccttactagttgtgaagttggcggctgaaacgttgccaccaattacagtctcacttctcttgtaattgaaggcgaggatactcttatcgtaagacgtaaattaactgacactcgaaatacctcagtttcaatagtcctaagctcgctaagtctgagtgtgccgagtcaaatgtgtcaggccatagagttcttgagaaatatcgggtttggagttagagcttgaaatataatgtagagaatgtcataaggtgatgtttccaatatttgggcctcatgcagcatctcaaatatctcaagtacgagctctttgaccattaaggtatttaatcatctacccaaatggagatcctgcccagatgttcaagacgggatcacaggttcctcactacatagccgtatatcaccatactcataagtccagccacaatagtttaaaaatgaaggccaataatcacgctctatgttcttcgttacccaattagatacgttttagaataactccatgttctctgtcccgttgaacaatgtagggtagacaaccagctcccctgctgcgccaagagctttcaagctcattacatgacgtagcgctaagacactatgactaactctgctattttacgagggcaattgttagtgtaataacccttctgaactgttgtgaggaatacgctcaataagcaaataaataaacatccttcgcgttttcaggatggatgtcttgcctggtaatataccttctcagtatgttcagattgaatatgaatttacaaaacagagctggaaataacgatcaatttcgttggcgtcaagccccagatggcacttggcaacgcgatatcgacgaggctgaacgcttctacgcaaccttttgcagaaagccggatgacccagatgccgcgtctttccctgtcacttgtcatgcttcattttctgcctcggtttccgaggccagcggatcatatgacgcaacaaccgagatgatcacggacgcgcttcgtgcagcttggcttgcgctctgtcacgaggccccaacactcgcgtcatggattcagtatgacccatcagcaggtgcttggaaaaggatgtatgcgcctttaaatggctttgaagatgccccaagtgtgtccgcttggctgtcccagactttcaagcaagtcagtccagatacaaacgatgaatggttcaacctcaacccgccggtcttcaaggttgctaccttgttcgtggtagcctccccttctgaccaagatgatctggtccatagaaacgtgtacttgcgttgcccccatgacctggttgatggaatcggcatacttcatctaattcatcgcttctttgaattggccaacgagagttaccacggagtacctctgaacacgagatgggatgggcatgaagctgcatatctttcgccacctctgagcactgcgattggaattcgaggccgaccttctgatgtgcagcgtcaaaccttcaatgatcttgtggcaagaaatgctacactccagacagaaaaaccgttgctcggcctgacgcttagcgatacctccggagggccagaccgcatccaacgcgtctccttctcactctcaaagagcttaactaccaaactagtcacaaagtccaagcttcatgctatcacagtaacccatctagtcagcgcagcacttactctggcccttcgggatctccagtattccccggcaggcactctgggcgtgaggtactgcaatcagtccattgtaaatctccgcgggctctgtctcccatcccaagatccattagccgtcggaaactaccatatgattgcggctcagtcaatggcgattgatctgtcatctgccccttgccataacactaccaaaggaagcgaagaagaattattctcagtcgcaaaacaattccgagattattacgccgccatccgtccagcatctaagcccatagaccaagaattcctttcgttcattcccatgacttgggatttgttcacgccaaagccgacgacacagcctccgccccaacagcaggtcgcctccgtggctatctcgtcacttggaaatatttgcaacattgtgaaaactgaatacggcgcgttttcgctgacgaccgcctgggtcgctggtgagacactgggaacgggcattagcaccttcattcagacttttgctggcgagttggggttctcgactattttcaacttggcatttcaccagcaagagcgcattgaggcgcttcaggagctaattttgaagaagttgactgaactatcccagcgactctaagacttatttccattgaaacctgtctgctgatgtatgatgtcagaaatgtcagtaatgggaacagggctggtatatatgtgacaactgaaagagatggagataagttgaggagataataaaatcttatatatatttggtctttttgtttgttgccagcagtatagagaggcttagtcttccaggtacactattcaaataaatatatatactgaattgtagaaacttcttagaccatctaacgtagaagggctaaggagtctttcttcgtagagctagactgccaagacttggaattttgaagtagaccggagtgtgtctccgccacttctcccaccatcatttgtttttgagctgttctctctagccttagccgttgctccgggactttgtccgggagccgttcccggtacataacccggatcgaaccaaaaatccttgtaaatacgtaccgacaagggccaatgttacgaaagcatggagcgtagttgagtcgcattcacacctggtgcaccagttgtcccacaatggccaaactactgctggtcgttcggcttcttgccttgattgcggcggctgctctaccgcaaaccgtcgagtcagccccagggcccccgactgcatccgttcagaatgggactttcactggattgcatctcccgcagcttaatcaggacttgtttctcggcgtgccctttgctcggccgccagttggagacctgcggctacggcacccgcaatcgttgaatcactcttgggaaggagatcgggatgctaccaggcggggcaacagctgtgtcggctacgcagggtttgcaaagggcctgaacatgagcgaaggtatgcttgctttgactcagtccctttcgtattttcatttgacatgacatgcttctgactcttcataatcctcgaatagactgcctgacattggatattgcacgaccagcccaggccgggcccggcgatgacttcccagtgctagtctggatctacgggggaggattcacagctggaggcagcgctgactctcgctacaacacgtcatatctagtcaaagcctccgtcgctatgaataagcccattctcacagtctcgatcaattatcgcgttggtggatggggtttcttggcttcgcaggaaatgcatgaggatggggcttccaacattggcctattcgaccagcgactcgccctgcgatgggtcaaagagaacatcaaagccttcggtggtgatcccgacaaaatcaccatcgccggtgaatcagctggcgcattcagtgctggctaccacctcgtctcatttgatggcaacaacgagaatctgttcagggctgccattttacagagtggcactgcgctcggtccaagtggtgagattgatatgatatctcgtcagcccttgcttgaaataactgaccctatgattactagtcaattcagttgagcaactcccgacaagcttccagcccatctacgataacgtgacagagaccgtgggctgttctacagccgccgacactctggcatgtcttcgacaagtaccgttcgaggctcttaatgacgcctttgcaccctttgttctcactcctattttggatggcaagttcctctctcgccttccctccaagtcattcgcccagggtctcgtggccgacgtagctgtcctggctggttccactactgatgaaggtacggccaccttcttcggcccccgaggtacgctgcacaatgactcagacatgagggggtttatcgagtctatgggcaatggactcgagcgtgggacagtcgacaagcttctagaactctacccagatgaccctagccaaggctgtccgtttggcacgggagaaatgcgcttcgagcagcacggccttcaatacaagcgcggtgctgccatcgtaggagacagcgtcattcatgccggccgtcgggctacgacggagtacttcgcatcgcgcccgcatcaccggagaaaaccggtcttctcatatcggttcgatgaacggccgtggaacggtgtcttggagctcattgccactgagacgcccgtcttctcaacccattactcagatgtctgcttcttcttcaacattgaccctgctgtcagtcagaatgacaccaactggatcgggccgtacccagactatcatgagctcgccgacctgatgtcgggatcctgggtctcatttgtgcacgggctggatccaaatcaccagccggccatcaacgagaagcagatcccattgtggccagactattccctcgggggacacaatttcgtcttcagagcgagtggaagccatgttgagagagatcactggcgggtgagccaattgagcttttggggtactatttgggaagccttgaagacatagacaggcatgttccgattcgactgtgttttcttccaatctacttaggttccacatgttgattcatggtgaagatttgaggtagctatgaacagactgactatgtactcttgtcatggcagtagaagaggccccatacatctagggtctttgctttcgagcttggataaagcaataataaatgaccaacgcgtaatatgaattgtgaccaattctagcagtatatacttgtcgcaacaatacacaccaagaattgagaactagcctccatgctggaccaggagacgggttattcggcatctgagcgcactaatctgcccggttttgatttcatatgacgttcgaaaatgctagagacggcgatgtggattgaccaggtgaaaagggggtattgcggctcacattgacaccaatgtcactcaaacttgcccttttataagaaagcccctataggccctggagagtgcggtaagacgccttgctagttgcgcaatcatgtaacgttctacctagtctacctaattgaaacgagcaactgggaactgcgcaatatgcaacttggcagctgcaaaagggatcaacctcaggttcaccttctccgacctgtccaccagtggtgcgattgggggaagtgctgcggtgtcgagttcgattggccagtcgatggggtaagcatcaacttgcagactgactggtgcgttcttacgcaagaagattggattgggcaagtcgtcgccgtctgcgaacatgtcacccaccctaagtgtctcagggtccagcgcatatttccaggcagaagtcggctccaagatgtgatctttggcacgtggatcaacctcggtgccgtcgagaggccgtaaatctgtccagttgagaggctggtggcttgtctctgtatactcaatatcggctgaatataagatcgggccacgatacacgccaatggtctcgttccgcgaaactgtggtgatttccatcgggaggtggaccgtaacctcgacggtgccctttttgacacccaagcgatgcaagccttcgttgttcgggcgcagagcttccttgcgtccgtggttgattttgacaaaggcgttctccctgacagtccactcgggaattctgatgaagaaatcaaattccgtatctgcatcgattttgtagtaaagagtatcggagaatgggtagttggtagtgacgtcgactgtatgcaaccttcagtacatgtcttcaaagcacttgttgtggtgtgcgtagaatcatatgcagcggagaagttgtcgggtcatacctttcactgatcttccatcgactgatgtttcgacagacatgggaccaaggagcatatgaactagcccttggttgccttttcttgcgaaagctgacgagacgtacttggggtaggcctgagggtgattcacggtacagcatggcttcgtctgcgtcagcacagcacgaaggaaatcctttcgacaaaggggaatctggaaattcacttacaaagttgggctcgagtccgaatgtgtttgagtacgtggccacgttgaaccacgggtcctccgtcaaattccgagaccacggctgattggtttgcgtcacgtactgatgagaccaccctgaatggagaattgatttaacatactggcaatcctggtggtacaccttcacgcaacttacagtcagggctcatggcagcagggagcgcattgaacgcagccaactccacacggtctgcgaatagattcgtaccatggtaccggtacagataggcgtacgaaaacatggattccacggccatgcaaagctcagaactggtccaaagatgtcaaaattgtaccaattgagtcaaattccataggggaaaatgttctgtcgttaccttctctgaggactctgagcgccaaggtgctcgtctccaatgatggtgccagacagcgaggtgtgatattgcagagtcatatccaccgcatcatttgtttgttgaacgaggctctcattcttggtacggcgatgcagaacacttggataacggagtcctgcattggcaaatttagtcatcgcgatgatccgttttgttgactaggtgtctcaccctgtgctaggttgacgccgtgggtaaagccactcgatttgaagtttgtgtctttgggaaacgtgccatctacaaagaacgtggtccagtcacgattttctaacctcccgccttcaaacatgaggtcgatggtttctagtatgacttcactattttggcgtgggtgcttctcgtaaagccacatcaatgaaattggcagctcatgagtccgtgacaccccaaagccccaaggatcgaaattgtcaccttgtgaacgatcttgaatcaggccggtgaagttgttctttagcatgctatgagcaaggtcgacgaatttgtgcagagcagtcacaatcctgtcagtttcagccgggtcagcttctgcgtattgctgcagagaaacgaattagttaagatggcacaaaattataaacatgatgggccatagataacggtcttacagttaggccaaacgctaatagtgatcgcgcccagatgcctcttgtctgccgcgtggtctctggacctagccagccgtcctctgcttgcgtgtctagggtatagtcgaggaatgcttttgcctggtctttcagacgctgatcatcgagggtccaagctaacgggactatgtagttgaaccagtagggcgccgcttcgttgagctcactgtactcgtattcgccgccaagccatgttgaccggttgacatagcgatagaagtcgaacagatggccaccaagtccttccgcggacagcgttatttgatcatggagccatcccaagggcttcacagctccaagtgggaggctgtcaaatttaaaaggcacgagatctagaaacacttcctagctaagaactggtattgtgtaaatgtataagagatcacagactgaccattctcatgggcctccgctagagtcgatatgctcgcgctggggagcagcacgacggacaacagagatgtccaaacactacgtgatctcatgacgaattatgacacaaatgctctgttgaaaatacttttggtagacgcacattaatgccttggatttgttcataaataactgtcatggttatccaataccgggctgccacccggcacttgctccggtccatacaacgaactaatgcttgatatctgaatgtgggggagcacatagccaaaggagaaggcctctatgcatatcgatatatcatggtccgatggcaatattctcacaaatttagccgggaaaggctaattgaagatttgtaatgaaacgcggctgccttcaattgcttatactagaaagcgctactactcggagaattatacaatgattaatcttaattatcctctgaggattacgcttcttacaggacaatagagttcaaatcccatgtgattccagtccatctgtcaacagcatcgaacgtagtctgccgccacgtcgctacccaatgttgcagtcgctcaacgtgagtacatgagctcgtagaacggatccgggctgtagttctccaagttcgtaagcctttccaccgaaggcacgtgctctctaagcaccttgttatagaattccctcgccgcaagccaccaggtagacaactcgccgcggccaacctcagagatcttgggccagggcccagcaaccagccgagaattgcaccgtgcatatcttgggtcgtatggcacagtcccatttgcattgtacttggccgagtattcgagtcctcggcgcaaagtactattctcgaaatggaacaggtcatgaccctgattccacgcgataagggaggcatgaagaccaatgccaaggccaaactggacatggcctaaggggagcggtcagcatgtaccagtagtgacgaaagggagaaattgcaatgggtagatgctcaccttggtcgcgaccagactcggaagactgcccagtctgggggtttatgagtcccttgatacctccacagacgttgttttggtactcattcattgcataattccacataacaacgtcttcgaggtagattgagattgccattagtgattgtaccatggcgattccgtaattagactggccgatagacacgacggcggagccatcaccctgtagagcatgcccgagaagccggtgctacctctgtatgactctccctcctcaatccagtccccttcacttctgagaatctccgcggcattgataaaagccatgcccccgtgaacccctaaggagttgtcgaggccggtgaagcgcttcagagttgtgccccaagcatcgatgatggatgatgccttgtccaaatgggcttggtcgcgggttatgtaccaagcaattgtgttgtacagtgcagcccagccatctctctcgaagccacggtttgtggtaacaacgcctcgactaatctcctccatcacttcggacatggtgtagtttgcgctggcacccggaagagcgatgaagcgttcccaggccgatttccagggctcctgctgctgcaagactccctggcgaactctttccaggtcgtcgtgggagaagtcgataccagggtgcttgaattcatagttgaaggtcttggtgaatttgacctcggatgcgccgttgtggtgaacggggaatagggggccgacctgggcatagacagtaaccacccaggcggccgcaatggaataaagtaacgaaattgtctgtttattgaacgtaaagggggtgatcaacagctagaatcaaggccaacgtttcacggatactttaggggctagctcttaccttcatcatgccaagtccatgcatggctttgtagttagaggatgaagatgcagaaacagttccaaagctagccagagacagtgaccttacatttaacaatacactacacgacacttttggcaagttcttgtcttcccactgtgctccggacctttcggcgcgagtatcccgcttgctttgtccattgaaattataaacatcatgtcaagaattaatattcttagaaatgggaagcgagcgggggaaaggaagccggtgatctacaggttgcatttcgaggtcttgtgccgatgcagtgggagtggacatagcttgtggtcacccccgcactgatcagcgttccggccggagtgacatccatgctccggggcaagtcacggcctggtatcggtatcgaattgcgacaccccttttgcgtcaaacacgctttgtaggatcgcaagtggtgattaggtcgtgaataacgatgtgcctttgggctctataagatcaggaatggcgaagcttacacaagatagagatgcgtagtctaagttcactcagtcattcttaatggacaaacgctgctaagggtactacgaaaatatacttcaagatgagaaatgccaagctggagatcaagactagaaatacagtacacctttgcttttttattggcgcacatctgcatttgcgcgcttgtaaggatggtgcacgtttatgattttgaagcaccttcttggttgagtattggccatagcaattgttcaacatcctatcaaatgtgccacataatatccaaaacgcaaagtcctagccagagttacggcgtactttcacggggcaaccttggcatatccgtcagtctctcccgaatcggtctcgtaccacttgacgtcatctaaatacagcgttctctgggcatcgctgtaattttcgctgtctacatagccgagtgtgtgagcctggttcatgtatgtccataggagcgttgggagttacgtaccgtaggcatattggccattcttgaagtaccagccacccagcgtgtccccatcccatgttccaaacccaacattaatattcttcttgctgtatacgttggcaccatcccaccaaacttcatacgccccacgaccttctcgcgacaccttcatacggactacaacgtcatgccaggtgtccctcttgagatccttgacaattgtggcggttgtaggatcgacgcatccggtcctatgggctgcgatgacagaattacccgagatctcaagagtcccacaccaagacgagcagccgccggggcagaactgctgagagaaaatggtttgcttgtccgttggaaacttattagacgggacgaagattctaaacccctgccatccttccttcttcatctgctggacgttggttgtagttccctcttggaagacacaaatctcaacgcctttgtcattacgagtgccatcaaagccagtctcatcaaagaagaactcgagggtgccgtcagcatctttggctgctgatggcgctttaacattgcacgccttgaagggcccgagaccgcttgagaagtcggcagagaatagggtcccagcggttgcgagagaagaaaaggccacaaggacgaacgggatcttgttcaggagagtcatagttgcgtagaatctaaataggttcaaataggcgggtgttctgtctttgggctaaggactcccttgatgtttggctactctgggaggcgagatctttatagcaaacgacgccgcggagtcttcgttaaagcctttctaatgatgaaatgcgaaccccagaggtaccaaatgacagggtgatgcgtaccccacagagatctgcgcatctaaccccgttccaggttcagtctggggacgaatgtccgggggaaatgacagtccccggccactcaatggtacaagcggatatcaacactccgtttcgcaaatatcactgtacttcgagcttccccttgacaacaacggatgattcaaggcttccaagatcttgggcatggtgaggagctcagctttcagtcgagaaaggaatccttgacggctggacactgcctccttcagctccttgttatcaatgatgcgaccagcttgggtatccacgagaagcatacgactagaccgtgctggtgctcacatctctgtatgcctcaagttgtactgctgttgttacattctcatcgccctcgaagcaatcttagtgccgtgtccagcttccggtaattgctccgttcactcttattgatcatcagacgaaggtcgcaaaactccgagcgcttggtgcggcaaagacatttccaccacttagcggctcttgactatttgcaagattcccaagtcttcctacagccgggccaagagcgggccgatcgagactttactccacgcatccatcaacatcagcaaacaacacccatctccaaatacctcccttgccctttacccgtcgggccatttgtcggaccgttttcatacagagaagctcgaaaacttgctgcggcgcttactatttacagcatatagtccgcttcggtcacatacacccgtgcaagagggggaagcgacagaggttctacacagtgtctagtgccttgaactgatatatcaaatcaatcaatgcagcgtcctgctactggtatcgcaaatagcttctaactataaaatggctagggtccttgcaatatggtgtgtgcattcgcgtaataagcgagtgaaattttcttgtagaatagatgaggagggcgcatttctagaatagcggtatgatagcgtgatggttctctgaatgtctccaactgttcttcccccggattgacttctcaacgactgggccgattaataatgttggtttcctagtactctaagaaaagagtcttgcctaaaccaaagggctgatcacggcgcatacggcaactcatgaattagtaaatcttatgatcctatgcttagcttgccacccacgcaataaaggaccccatccagcaatcgccgtttctgtgataactcatagaatgctatgtttggaacatcaaagaagcaaatgagtctatttaaggcattagacttctcacttctgatcagattcacgtttggtctctatcaaagacctatcttgttcgatcttgtggcaagacagatgctatttaaaggtctttggttcgccacaggtttattttggacctcgcctctcggtggggctgaccggtttgcccctttgagtaagaggaaagacattgttgagcaatgtaagatgcacttggagagatggtattgtcctaggcataagtttaataaatatgccagaaaacttcgaattttgcctcgcgccagatcgagttggcacggcaatctaacgctcattgagcacgcatttctcggcatgtgtaaacgtccactgtggaaaactcccttgctttgggttcttcctcggtgcagaatctgcagatgtcctattgaagagggtgaacatgtcgttataggtgcgagacaagggaaaagcccttctagagtagctatgagtagctaattgagttgcggctgcagtgacggtggatggttatcggacaccatctttcacgtactctgcaaaccaaagcttccaagatgaagatctcagacgacgcatttactgcagtcaatatgttagcagctggttgcttgatgaagtggccattggttgccatcgcgagtgtctcacattcgcctgcaagcttgtgccgtgggccgagttccgaccagcctctgatcaggagacatcttctctggcgaaggccaggctcaactactccggcaccaattttaagcagtcgcggttcaaaaataatttgattgccatctacggaaggcacaaggaatcagatcccttagagcaggaaatgctcggcgacggcagcccatcctccacaacttcgtctagcgttgaccagggcggtgcaattggaacacctatttctcggttgtttgcaaacagcatctactggtataatctcacgccttccgaggagcagcacaggcttcaggtcttacgggaagaactaggatggaggctcagcgagaccttgagtccaagccgaaaattaccttgcgagatttccactctgatcgctgaccaccttatccaatattacactatcacggcatctctggtactgccatatgaaggggagtccactgctagtatgtcaaatgacatttgggcaacatacatacagatcgacggcagatcatacatatcctgcttatcaaatgtgccgactagcgagaacatgaaactagttctgcaagccggcagccgaaatgaagaagacactctttacatcttgggggatcatatggggatccatgaaattcatttctccagtggcctgtccgaagcgatcaaaccagctggattttcctcatggtggcgcgtccttcccctagactccaaccagggcaagctcagctttttctctgatgtgagtttttcgtctcttctcgactacaacctttctttctgttcctaatgagactgcttcttcagggcactaaacttcaatcactatcaaattataaggcaagaccatattcccaaatcccccttctcgccgagcatatgctgtgggccgagccaatcactacaaacgaactatccagtctgaaatatgtatgctcgagatggtatgacgtgtgttcacatggcttgggcacctgcaggatggttcccgttacgatcaacgcccccggttgtaccggttattctgtgcacttccggccatggccagacaatgacgccatcctgggactctcaggctttcatgaatacagggctggtcaagcacttgatattcatagaacagcagtctattgtccatctaatgtaatttgcactttcgtgccgatgaaagacggagagcgtgtgcatcaagtctggtatggatgctccttgcagtctgcgaatgccagccatcttgctgtgagtttatccaaacaacggcccgtacacactacgtcttacttacaatttgatgtggcagttggtgacaacctctgggcggtgcttggtcgtcatcgcatctagccatggtgtctgcccggttagaagaaggaatatggacgagaaagagaaatacatatggaagctagcagctatcgcttcctcgaatgaagaagatcggttgtggcttgtgtatgacagctcgaaaaacgacgtgctcgcaggcttagccagtcccagagctagggaggatgttctgctgccatcaccgctggacatagcaactgtagattttacagacgagcagtctcaagttttctccggggttccgtctgttttcgtctgggaacaattaatatgttagttgcatattctctttttaggtctcactatataggctttactagcctctggtcattgcaaatatgtgggagaagatgattataagtaaagagtcatttttttccttttgtattcattcaatatttattagaagtgacttttcttgcccatattttgaagagttagtgtttctgtgggtagattatctggggcgctgcatgaatttggtgattattcaacacggcggacacgaattatgccgacggaccaatcccaagactgacaaatcagccagaaagcaacacaatctgcaatgtataaaaacaaggcgggatcttttgtttcattttttcggatcccttccttcacatgcttgcaagatcattattcacgcacatccctccaatctccaatttcccacacgctcatcatggcacacagggcagaaatccgccaacagcctcccacggcattcatcaccggtgctaatggttacattggggcggccgtatgcaaagctttcgtcagagctggctatcgcgtcttcggccttgttcgcaggccagagtcggctgctgatctcatccgcaacgagattacccccgtcatcggctcgttggacgacttgagtttcctggaacagttgtacacccaagcccctacattcgacgttattataaataacattgaggggttcggagactacgaggtccttttcacgaaaatcagtgcccttgtcaaagaactcgccacaaaaagcaatgccaatggtgtcaaaccactacttctctggagttcgggttgcaaagactaccctctttcacccttccacggggatgcacacctcaccccgctcacagaagaatctcccatcctttctgctcttccaccggcacgcgtaagagcggagacatctctgcgagtgtttgatctgcatgagatagttgatgccatcattcttcgcccaacctcagtgtatggatactccagtagctactacgggttcgtcctggaccatgtgaagaacgagaaagcaagaggcgcgaatgtcttgcgcattcctggcaaccccaatagcatcatgcactcccttcatgttgatgactgcgctgaagcatacgtttcacttgcacagcatcctcgacgcgaagaagtcgccgggcaagcattcaatatctccggataccgatatgagactgcaggcgagacggcttcggcgcttgcccaggaatatgggctcagcggcggtgttgagttcatcccggtcgaagatgcacaaggcaaagaggcaaagcttgaaaaccaaggggctctttcccttgttttctacttctcgcagtgggtcggctctgacaaaatcagaaaggtgacaggttggacggataagcgaggtttgttttgcgagaacctccacgtctacaggctggcgtatgaggctgagcagcaaggaggtcatgagaacatcaacttgatcaacaataggattcatctaattaaccagagttagacgaagtaacctaaattttcaatgcacggtttatctttaaataccctgccccataagataacagtgtatactaggtatgaatcatctggaaaggggatcgagcctcaagtcacccctgattcctccttcgccttccgctgaaagtgctagatgaccagctattacaggtctcggatgtcatgaagcatctgcagtatacatttatgagacatcatagaccaactcttcgttcagcttgccgttagtactttgtctaatctatcagaaacactacttgacctgccgccatattcagcagtgcattgaggtaacttcgctttttgataagagctgagttaccctcggactttttccgggtgtgaaggcaatacgtttatcgtctctggctcgtctcccagataaatcttgactacacggtcctaagcacggctcagaactctctgcccctggcccatgtgcccttatgcgtggggaaggtgtggctgccaagaaaatagcgaaacaataacccctatcgaactctttgcgtatggtttctatttgtagatgggcaaccagaaagtcagccatagcgatgaggatgctggctgcttcttcatgaggatatcaggggtctcttaaatgtcaaaacttgtagcattgctgccactctattccagttatatctgtctatacagcttccaggatgatcactagtcctttacgataatattcatcctctttcttggtgttctaaaatattaaaattgcattatggcttactcccctcatcgctacttcaatgctctacttcaacagtaaccacattagtacggatgcttatacattgggtaggggttcatcctctcaccggctgatggatcagagtgcttcagccctggccaacaaaggccctttgcatgttgcaaatttccgcgcggcatcctcatggacccttctggacgtagcccgatggcattaacatgctcattatcataggcactgtcttcttccgcttgtgaagtgacaacccgggtgtaagctgtatgctttcacattccggcggtatagagacgaacgaatttgcacggtcaagtactagcgctcgggaatgcatctaacttgctacttcattcacaagtggatgttgagttacattgtatcgggttctctcattgagctatagaatctttgatagtgatcaaaaccctcgggtcccaaggctgaatcaaggctgtaagcgagctcttcctatgtctatttccgacgaaaagaatgaatgctcgttctatgggtgaaatttgcaagccgtggtctagacacggtgggatttcttcctccggtttgatagggaaggtatcatcgtttcagctgtatccgaccagtctgggaggttcccagcggtatgggtcatgcaggaacaaaataagagaagtgtcagcatacgtatgaagacaataacttttcaccattcagcgtatcagaaactatcaccatgagctgcaacagagggccaataggattagtcaccagataatggaataatacttcgacgcccctacctcccagttcgtcagacaaaaaaagaacccgattgccacggcgcccaatgtaagcaaagggttaggtttccagagtggttctacggagtacgggagttggatgtgtgggaaccacctgtggctgacccagcggcaacaacttcgattggtcaaaatctagggtttgtctctatcaggtgtattggttcatgcagcattatggcagggtgcagctttgcaacagtaacatcaaccctccctcgctatgtactaccaatattacaggaagcgggaaattagcatttcaagatctcaacctccaattacgacgatgctgattttttgtcttagctagtaaagagaatggtgtttttatttgcatatctgtgtttaatttattgtgatttcaaagcaggcgaaaaaataagaatgtaatacggagtggtggcgtgttgccagagatctaagcgttcgattggatcaatcacgagattagatacctcagactcgtttcagctactccccggaatgtgggagggggaatctagactccagcagattcttgcgtgacattaccacatcgtgggacggagataacaagcaagaccctggagtctatcgtatgcaggcattacccaaacaagaacatgatccttttttagttcactttcaactcgacggctgaagaggtgcaaatttcatgcagcagacttattcatgaatcctctgcaggtcttgggaggaagttgaatatgatacgacatcacatcatgtatattgcctttagggtgagtctattcctaattttagatgaaggtcatttcaatcgtcgttgagcgaatcgtctgagcccgaagacttgtgtacataaaccccaaggtctactgatcatgctcgaatctttagactcacatctttacttctgtcttcacttacatatttgctctgatcacatacacacttactttttcaagtatattcttacttcttcgcatatatacttactctctccacaaatatacttactctctggtgtctggttacacactttcggcttgattccccaactcaagtctctcctttctttcaaaaacttattcggtctccatccaatctcaacaatggtcgcagtaaagcagctcggcctcgccactcttctctggcttggcctcgccaaccaaggcctcgcgctgggcatcgacgagaccactaacgacctcaatcacgtgcagagaagagtgggcagttccttccttcaacgtcgccccaatactcgcaaagcctagggcggaggagattcagtctgatgaacgcgatattgaggagcttgacgagcgtgacctcgaccttaaagcgcgagggttccgcaagggtctcaacccgggcgttgccaaatggcaaaagcctcgcgagcttgaggaattatcttagatgagtgtcgtctatgttcaatgaaagggctagtctaatgacaaatccggctccttcttctccccgccgcaatagccgggatggataacgtggaggctgcaggccgtggcattgggattgcttcagatcctagagcacattcggaagaacgttgtaaaaatcgcagaaagaacattgctcccgaaagactttttttgagtttagtacaataaaatacaataaaagatttcccgcagcacagggctacctaataaagcgatatttgaattacagatgtaaatgtccatctaaggataaagatggcctggcttattaagcgagtcatgcaattggtgatgaagagggtggtcacgtgctgtttcagatatcggccccactacacgtcacatggtccaacgccttttgtggatgtttgggcttgttcgcgcgaggtagttgctctttcgtgcagcttgagccgtggagtagtcggagagtttggcggtcagagctagcctaggggatgggcgattcgaaaatcaaggcagaagctcctctgatcttcaacgacgcgtcgactccgctccagcccacccagacctgtatccatgtgttccactgactggccggaacgaaaacggaggtaagacgggtaaatgtcggtcagcgcacatgcatgatatgcgaaatacgcgcgataagcacccggtcaagacgctcccagcgaatgagaactgagacacaactcccgcaatgacgggccgacagtcctgctctccaccatgtgtgacccgcccagtgaggggaggcgaggggagcagatggctggtgctctgaaaagtcggaagccgcaagcaggccggggctcgagaagaattgaagcatgagagacttcttccatctcaagccagagcagcggaagcacaggaaggcggaataccctgattattatgtctccaacagccgccaaagacccgaatgcattcccctactggcaactgaccgtcctgggtgagtgaatgagacgctgtttcgcctcgacgcggccgatcgctaatcaatcaccttgtttgcagcaatatgtcgcttctctgagccaatcgcgttcaactccatccttgcctactcctacccgctcgtcgtggaccttcatgatggagacgagacagacgctcccttttacggcggactgctggtgtccgcctacgctgtcgccgaagcagtgacggctgtcttctggggaacactgtccgatcgctatggccgcaagcccattgtcctcgccggcctgggcggtgtcgccatctcgtgcctcatcctcgggttcgccaagagcttctgggtcgcgttgctggcccggctgattggaggcgcgctgaacggcaatgtcagcgtgatgcagaccatggtcgccgagatggtcaagaagcctgagcatgaacgtgagtctttctctcctcctgtcttctctcctctcctattctcttctcctcatccgccatcgcgtcgatagtgctgaccagcctcaagctgctgcctacgccacgcaaccgttcgtatggacgctgggtggtattctgggctcggccatggggggcttcctcgcccaaccagcaaagttctacccacaccttttccccaaagacggcctgtttgggaaatatccctaccttctccccaatttggcctcggtaatcatcatccttctagccattctgcagggtatcatctttctggaagagacaaaccccagcggccactggtatcccgaacaagactacagcgccattgagcaggatgttgacgagaccagcccgctacgcgggcgcatggccaagacacccgccgtcgcgagcaggccctctgtggacgctcagtccaggccattgattgctgaggaaggcctccccttgcccatcgaccccagcttcgacatcaggaggagctcattcggcacgatgcacaatatcgagatcgcccccgaggcgagatcatctggccagtcgacccctcgccccggcgccccctacgacggcccagtctggaactactccatcatcatgatcatcatcgccctcgtgatcattgcctaccaccaaatggggttcggagccctcctccccgtgcatctcctcgcacccccaaagcagcccgccggccacctcgacctgattggcggcttcggcctcacgctgcaccaagtcagcgtctacctggccgtcaacggcgtcatcagcctcttcatccaggcgctcatcttccccatcttcgtggccaaggtgggcgtctggcgctccttcgtcatcaccatcgtgctgtacccgaccgcctacctgctgctgcccttcctgtccgtctcgccgcacttcacgtcggcgggcatctacatctccatgatcctgcaggccttttacggcatcatcgtcacgcccaccgcgctgatcctgcttaaggacgcgacgccctcgacgcagctgctggggcgcgtcaacggcatggccatgagcgggtgctgcgccgcgcggaccatctcgccgccgctcgtcggcatcatctacagcgcgggcggatctgccgcggcgtggttcagctgtgctggagtcgcgctcataggatcgttgcagcttatctggttccaggggaagcatgtccgtcatgttgtggttgagagtgccgtggttggcgcgacggttgggaacacggagggctctgcttaggaatgcagagttggatcaaattgccattatgagtttgtgataaagctcatcggtctacgtacacgtatgtatgatgctttgacgcgatcagcgaatgttcgcgacgcgtcagaattacatcgcctgaaataggctaccctggagaagagttagtgaagaccgtagtttgaaagtagtggattaatagattgtgaacaactatactcaaggtattgaatgatcgcacactggccgaataaatcatttgtctgtgaagaggatatcattgttctcatacaattgtgtattatgttctcgccttgagcagcacgtccaattcaggtgacaatctcctagccgattgctgtcaccacttgagacaaaacacgtgccgtgatattaacgcactctctatgaacgcatagccatcaatttattgcacaattttccaggtacgtttatctcgttttccaaatagcaaaaaaaatgtcaaaaagcaaaaaaacaacttgcccccacacagaattgaactatggatcttcgcattacaagtgcgacgctttaccactaagccataggggcattgggaagttgttaccaaaaccttgcttgttaggtattatcagccccacaatcaatatagatcaccgcacaaacatcaacttcaatgtgaacaatccaatcgcggttctgacataatgcagcatatgtgcaatttcgcagttccagccagaagctatcgcaaagaacagagacggcaagctaagaaagccgagagcagcatcgatgtgcatcatgtacaacggatctacatgcaaagtgtagactgagcgagaaatagagaccactaagcttgctttcggagcatcgcttgtgaattcaatctagagttacttagggaccgggtaaatctgcaagggacctcaattcttgggtgcaaaacgggcgcttgacctggctgcacgctctcgttgggaggtgatttgatgtgcactgtagccaacaactgtcaacagacggccacccaaacacgcgttgcgtttgttgttgtgcccccaaaaccacgtcatagtttctcaggtctcttcttgtacattttgaactccgcacaagcactttcatccactcgcgtttatcatccacaactcgcttcaacacttttgcactacttgattccttgagtttgtgcaactcgttgcttacccttgtccgggcattgatatcatgaaagaagaagagagccctgaagatccaaagcctactaagtggcctctcttcatcgaggagaaaaccaggaaactggccttgaaagaggagccagatcttccggtgagcttcatttcccaccccgattcctcatcgttccgtcgggttaacattctccattttcttacgaccagctcttagagcaagccgaatccacaagaaagccgtccggaactactgagaaacgcgcccttcctccaggccctaccccgacaaccctggccacaaaacctggaacgaccattccacacccctcacctgtctcggatgataagacggcggagattctcgtcctcctgaagtcgatgcagaaaacccagggagtcatgggccagaggatcgaaaccctcacgcgggaactctctaccatgaaacgccatgtcgaaagcctcaccgccaaggggacccagaccctcatcgacctagacgagtggatgacgaaccgtcccaagatcgtctggcagcagagatcgatgcatgactttctcgaaccgccgcctccaatgccgcttcctcccatattctcagctttctcgcccgctccgacacaaacttcggcagctccccccaagcagagccagaagtccgagcctccaagcatgccccagcgtccgctgccggcgcaacctgtgaggagagaagtttctcagcctgctcgtcctatggcaaccaagaccatttcgaagaggcggcctagtaagattgcgagacctgggccgccacagaacaacacggagaatcagaccaacgctgggagtgccccccgtaggtagacaactgaggtagaggagcccttgaacgatctttgtgtgtatgagatgcaagtaatcagcagaggagtgtaatgaataatcggccgggatgagctgggattggaacgagggcaccctgccattgtaagaaataatttcatagttctgctctagacatgtatgcgaaactgttggattcctgtaaacggtcaatcatcaccatctgcctcgtatctcgttcctccctgccgcctcatctcatccatcatctctaatactcggatcgtctcagaccacggcatcacccagctctctttgcgccctgctagtacgtcaagcgctgcgctgtccgcctcgaactggtagccgcgcccagggacgggatatttgtatgttgtgccttggcctcgtaccgcgtcttctcctgattctcccgtgaatttgggatacaccgtgaaagcaacgggggcggatggacacgagccgtgtacctcgactgagccattgacgccgtggattctcgcaagcatgtctgggtttccattcgtcagtgtcgtcgaggtgacgactccctgccggccggagggatagcgaataatagcactcgtcatcagttcaatatcctcccagtgtgtctgtgacgccaggatcatcggccgctccgttctctcagggctctcaggttccagcgccatgataatccaggtgagggagtagatgcccagatcaagcagggagccagcccccagcgccgactgtctgtaccgcgacgtctctgggagattcggcacgtccttgtcattcccaaagtcggaaaacgcgcggaaaatctcaccaatgaccttctccttgtgcagcatccgtcgaagatcgtgcacaagcggccgatgcctcagccacatggcctctgccacgtagacgttcttccgtttggcggcggcgaaaacctccttggcgtcgcgggcgttgagggtgaaagccttttcgcagaagacgttcttgcctgcggcgatggcatccagacagttttgcttgtggaatccgtggggtgtgccgatgtacacgagatcgacattcgggtcatcgtatacctcttggtagctgccgtagatggccggggagtgggttgggcagtgttcccttgcgaaagctcttcctttgtcgagactcgagctgccgatggctgtgacaatgtggttgaccttggcgtctggacgtgacatgacaatgtcttcgacgaaccatgatgatatcaagccggtggctgcaagcgacttagtatgatgagttggttggtgggtgttggaggaacgacatacccacgatgccccagcggatacttggaagtttttcttgcattttggcctgatttatctatcccggatcttgattctacagaatcagttgacaaactgagacaagatgaattacacatcctgagtaggagtctcctgtctctaagtatacttcttaaaacgaccctcaatctactggtcggaattcatacactagttttgatggattcggcatataattccgatattctcgcccttcgttcagtctgggttattcttaccgacccccataatgtgggtgcggggatgaatggagcagatggagagagtccgtttctccgacagatggagatattgcctcatctggcaaggcacggcgatgccagtttaggcctaagtcagggctgcgacatgcctctggcttggttgaaaggaacagtctggttgatcgatggctctgttctcaacgatgttccctggcagcaacatatatagagaccatcccggatcttcctctgtaaggatgagaagcgtccatattccctctcctgctggaggcccggttgcatcttgcccaggcaggcaagacatgcatgagactagcggaattgctgtcttctagctcgggccgtgttggctcagccgtttggtgctgggcagacttgctagaacagaatgggcactcttctcttgtatcatttaggttattgtctgatggcttcataggatcgagaaaccgtccttcataccattctaatccttatgaaatcatgaaattaaccatctcccccgccttgatcatggagcaatgtgctgtattgatctgcctgatggaggggctgttaggcagccattcccaaagggggtttcagctgaagtgttggcagagcacagcccaaggcttcctccaatatgtctcacccgcattaacttaaatggcggtgcaatctggccaaatccccgcgtcccatgtcttcaatatatttgattctccattacccaaaaaggacactcctctttgatcctacagcccagttagcagaatgccagcgatccacatcctcgacctccctggggagattgtcgataacatccttcagcaagcaatactggttcgagtcttgccgattggggactatgaatctccaaccggaatacccagagtgctgaggttgagactggtttgcagtacgtgatgcccatcggacatggatgtgttcgtatcctaacagcgtggttttagagagctttgatgcaatctttcggcctgccttgtttgcaacgcggatattcgacacgtatctcccagtttccacctaccagcccacgcaagctttgagatattggcccatccgcaacaaccatggagcgcaacaactgtggcacgcctacctcgtctaccgcgtacagaatgaaacggagcccttggcacatcgatatgttgagattcgaacggcagcagagaggctcttcaacaccaaccttactggcctgacattgcagagtataattgaatctgtctgctggttagcgctcgccagcgtggccgggaagatagccctgaaaacctacaatgatcacttcgtcatcaagaatggcgcggatctcaatttgctcagtgctgcagcatatctgaactgccaagacgtggtcaagagactgctcgcggaaggcattgatcccacacaacacgacgacctccttcccgcggccattgaagcagctgccctggcaggccatgccgacatgcttcagatcctccaagaaagcctgccggatatggtccgtcctccagcagaccgtgagactaaccctcgaggattcattggtcacgctacattgcctacagtcctctgcaaagggaaagcagacccccaagctgttgttggtgctgccatgaacggcgatgtcgagctcttgaaaatggcactataccccccttctcggagggatccacggagcaccgattattttgagcagcctcatggaaaggtaaaagaaagatctctgccgggtttgactctaagggctgccatgctgcattcgaaatcactcaatgtctatcgtatcttgtccgacttctttgctcaaagcaccgaactattcccggcctgccaacgtttggatcgttattgcgagtttggcaacctggagatcgtcaagcacttgcttgacaccggggtgagcgtgaacatcgagccggggatgagggccgaacacccttcggcactccacgaagcgtgccgccacggacatgaggccattgttgatcttttgattgaacgcggcgcccgcatcaaccagcactgcggcagattcgaaacgcccttgtacgcggcggtctcgggaggtttcatcaccatcgcccagaacctgatcaacaagggcgcggaatgcgacttgaaattgctcaagaattccttgtccagtgagtaccctgccatgacgaggttgttgcttccgcacctctccgcggaggaagtttataagaacttgcactacctcactgatgatgagagactggacaagatgcctttgttggcactgattggggagcacccaggactgagtttcaagaatggaaaagttcggccgccagtgcctccgaaggctgaaagcctttcgaatcccaagttgagacgagagggtagaaaacatggaaactttggactgcgcgaatcatctaagttcgaagattggcttcgtatgcgatatggtgccgtctaggtccgcaggatgtttatagttcgtggttatggcaaacggttttagtccctgcccgctgggtatcgtgaagtgggtgaggtttttcccaggcaaatttactgtgctttcaatgtccctatgttagatacctcctattttagctctacttaggataggaaattgacttgattgatggtaacaaaggttggcttctatcctaacttgccgatttatgggtttatcacgaagacaaagcactgaaccaagttacatcttttttattacgttttgacacttttgagtatgcaatattacgcattcagtttcgagagctttgaaacgatgtccctggtagagagtattgtcagcttcaaaaaagaaccaatgtaactaaaataaagagaagcacacgccgaaaatagggacagaacaaggcctgctggggtttttgttttctcgaagatgtcttcacttgaagaagcaaggtggcaaaatcttcttcaattaaataaaaaaacttagttacacatgagctagaattaattgagtaagagaactccctgaatgaagactacgaagcaagtagggtgcatccacttgctgccactccaagctattttgttatcccctccttaaactcaacgaaccataatctacgaaccatatgtagcatattgcatccgggggctcattttagtttgggctttataagccattaaccttaataatacaaagagattccaggtgtgtgtgaatcaagtacgctctgagcacttttttacattcatttagggatgtgcgctaacaaaggagccttacattctgttttgcttgaacatgtcgttgagcccttctggcttatataaacaagggccctcgatcactgaatggaattatcgaaaagtatccaacttcacagatctcgacacccaggacaacctgagaaaccagaaaatttcacctggaaaactctcgcccgaaattgctgaaaccgacagtctggctctccatcagagttcttaacttctccggacacaatgtctgtgcagaatgatcgcctaactatgagactcggctatcatgctgagattgtgctgtatgggggaatcgctcctacgggcacggagaatctcccgtggaacagtcgcattgccaccgactcgcctatggtccaaacggacgatcgcgctacgaatattctcgtttacccgagaagcttcattcatagttgacttgagcacatcggggtttaacgagatcgttcagcacgatgtcgcttagggccgcttggaagccgacttggtcacctcgatgaactcaatgcttggagagcagatcctactccgtggtctggacactctacgtttgttagttgaggctggaaactaccaggacatccacagggttctccacagaggctaggatgggccgctccattcaagttgcaatgttttcaggcggatagagcgcacaggtagcaggtatggagcactcccggaattcaatccaaatgtaggccctttctatcaagatccggaacatggcctaattcgggcttgggagactgtgtacagtgtaccctcgaagtctggatactcggcttgatagatatcgctatatccgcgagtatcgccgtcgaggatatatcttctgggatgaaacccagcacggatttcctgacatgggctgggagacggaggagactctggaccctgaagaagcatactgggaatatcaaatgcctaatgcctccacagacacattggagatgtcgagaacacgacgcagcgaaatatgggaaaagggttggtggagctgtgatgatgagagcaaggttgtgcatctgccactcgaggatagatattgaacgtcgctttcaggtcgtaggttcctggtctgatgaggagtggaaaatgtggtatgcctggtatcgagatgtgagcctgcccggatagttggacgagagattaaggtcaacatgttattttcttagctgtgcctttacgtcctaacacatgaaacgcgtgcagagatgtgtaaggagtggtggaagtttgtgtacggacattttaagacctttattaattaatctctagcgtgttcaggaaaacattatttcatcagacgtgttctcagccgctgcttccccccgcgggttcgaggaaacatacatatatttttctttgagaacgcagaacgaaatggtcttccctgagatcaagtaaaagccattctattttatcctgtagttttctaggatgctacataatccaaaatgatttcataacagtcattagtagtgcttttgaaacctccaatcatgccaaaatacccattttgcaaaaccccaaagaaaatagaaccaacggctgaaagaaaacccgctattatgtttcatctacctcggctcataagaaacgccgttgtcacttgccctcctccaatctttacaaaagcttactggtccggctcgagtctagtgtacacggaacgctgacgccactcgcggccatgctgcatcacgaggatcgggatcggcgcgagcgcaagcgtgatgaaggctagaatcgtgaacccccacccgtagctgaacgtgtcgatcaagggggtggcgccgagggggaggaaagtccccgcgaggcatcggatcaccaccagtcccgtcatggccgaggcggagtagtcgccgaacgcgtcgacaatgtaagcggccagcgggatctcgacagccagcatggccataccgatcaagccgacagaggtcaggaccatggagagagggagtttgagctccgcggcccagccgtagagggcaatggtcaggggaagggcgagggcgccgaagatgcagattgggagtcggaattcgggaaggccgatgccaccgttggctgccttcatcgtggcgtagatcttgtcgagggcgagattgcaaagcataacgctagcaatagatccgatgcctgaaattgagttagtgagatgaatcgtacgcctaaggggtcagggtgtcttactgaatgagaataaggagacgccgatctgaggagcggacaggccgtagatgttctggagaatgtcgggcatcgtcgtcgtgacgttgtagtagtgggcatacgcaatcgcaccagggagggcgagggcgagcagaattccagagctgctgagaatagcggctggtcgaacaatcgactcaatgagtccactttgaccctcagacttgatctctacgacttcatcgttggcctcgagcctcgtagcttgtcggctggccttgtgtagcaatcgttgcttcttcttgatgattgccgcgtggtacgtctccttcaggcaaatgatgaagagaaccgcacacgccgaggtgagaacgacgttcatccaaatcacccatcgccagtgaaggctctcggcgatgtagccggagagggccggtccaatggcaccaccaataagaggcgcaagcatgaccagactcatgggagatcctcgctgctccggctcaaagatatcaccgacgatagcagggccgagaacgttggaggtgacgacgaggccggacagagcgcgggagacgatcatgacgggtgccgtctgcgctacggctcccagtgccgtggccatgacgaagagcacgctgcagatgttaatgaccgggtaacggccgtacatctcagagagaggggcgatgaccagggggccagcagcctcgccgaattcccagatggtgacgagtaggacgctggcatatctgtttggttggccatcattcaggtcctcgatgatacggctggcaattggcatgggcgagatgcagttgaaggttctattcattacgttagctaaacctcgatcgacagtgaaagttaaggcaggtatttcttacactgtaaaggccatgaagaacagcagtgaagtgactagccacttgaagctgctgggccatttttgaggattctcatagtcgcctacctcctcgaccttggagatggagacggtcttgtgcaggtcattggagagatctgaggccctgagtaagggctctctctcatcaactgttcgcaaggtcatcctgactgcgtcattcacaagagatcaaattgacgaagaagaggaaagcaatgcatggggtcatccaatagatataagacaagcagtggcggacaagtgggcagagatttcgcgggggagcgtaatctcaggtgggttcgggttccacctgcacaccgagtggaccgctggaagttggacatgtagatgcaaggcaatgagacgaggagcacaggaagatgctggtgtgcaggcgggggtaaattggggcctgtgtctctgtatgacgttgtggccaaagaagagccagtgttgttgggttcaggctctcctttttggccctttctctcctccttctccctccacgcaaaccaacgagcacacgagcaactcaggccttatcagcagaaatacaggccgcgccctttgaatatacgggcatggcatgggcgtacaggggttcgtgctgcagccaccaaaccgtataggcaaagctgcggagggtcctagacatggcttgcgtgacagggcgcgttcgacaaggcgggctccgagcgcccagactgtccagaggcgtcaagatctactgccaccggagacggccggtcaggtggaaagcgtaaaaaaattcacagcccagtaatacgggcttcccgcctgggctcgcggttaccagcggttgctcgcatcactcgatgcccttctatagccgcggcagtccaccctggtcctttcccatccagctgttacgaatgaaagactgtcttgctctggctacagttcgtttcgggccaattttggcatgcatgtcgaacatgcggtaacgtgatggggggcagatcccacattcctgcagggggggcaaaccaatcacgggggttgaatcaccgctcgggaactgtattaataagatggaagaaaaattctcaggccggttggaagggttgcatcgccaccgtcctgcagccaggcttgccaagcagtggtaagttgatgcatgttgtagcacgggaagagaattatcatccggaaatgacatcacatcacgagaaggcattgatattaatcctccgtggcccgattctattttgccggcgggagattgtctaatgcatgcatcgacgcatttcccgtggtgtttttggttccattgaggatgtgaatgccttcattttctatacttgccccagcagcccctgacttgttcaaccaacaggcgcaagcacgccagcacttgccatggtattattacaaaggcattgatgcaactgaaggtcataagtcatcaattcctccacaagattttcaccattatcagcaaactccaaaatagatctatccaatcatggattctcgatgtaagcgaacaaaagtgccaaatattaacaaatttttctataaattcaaaacctcgataataaatattcacgccttgcggcctatgtcccaagtaaattggttgccgaggcgaaaggttggccggcgcactggagccggggtgattttgttgtacagagtcttggtcgtggcggcgattcgcctgtaatacaggacgatgaacgctgcgagcgttgacccgaaacccgtcacaacaaacatccagatgtctgtggatacgtacatctttctgtcgttgtccagctgggtgaagttcattccccaaaagccctacaaggtcacaattagcacggggaattcgaatgaatggggttgccagatacacttaccgcaacaaaagtgaagggcaggaagaacagggtcaaatgggtcacgaattttgtcaaccccgtagactcgtttgactccttgagttgataaacgctgaccatgttgtatgcctacacacggtgccattagtaaagcatatctctagctgagggtaataataaattctcaccatctggatttcattctcaagtcgggccacaaaggcatcagatcgcagctttaggttgttaagaaagacgtttgagaatcggatgccagcaacgatgttcctggtgttcgtggttgcaaggcccagcccagatccaggactgatcagccttgtctcaatatcgcggagggtttcttcgacggtcttagaagccgcttgaagtgtttcgctcatgtgaatcgaatggcgtgatagctcatgcatgttggtatactttttggtaatcttttcactctctcccttcatttcgatggcgataacatcttcgataaatccctctcgagcctggatgggatgtcagaactggtctgatatccgtcaaaggaaaatattggagaactctctgacattcccaacgtggtcacacataccttctcaatgtttctgactggttcccggaacccccagagcgcggaatcatattcccaaataaccacctgcaggaaagcatcatagatggcgagcgggttatccttgatgtctgccggggagtattttttcaacgcatccgagatcttgtcctccaattggacacagtcgtcatagcaaaccaccacgcaggatactttgtcgtccttgagattcttagcccataagatgctgaacgacaagaactgccaggaatacgtccacttgttattcgccgacgccacgatcttgatcaaaaatcggcccgcgtagcctgatacggttgtaagcaaatatcgccaaagccaattaaaaggtagctctcactttgaagatcatagttctcgggaggtgcgacgtgtcgggtaatgaggaacccgttggagtcccacgccttgtgctgcaagaagaaaggcggcaggtgaagactgcgagtgagttcactgcacaaatctgggtcatcgccaagaacacccgatttcttctcgtatttagggtcccggctgatatgagggagaaagctagacacatgttagacagacggttaagactttctgttcgattcttgcacatactacagctggagctcatccgtctataatcgcagtcagtgagatgattacaaaactactgatttagggttttttacttgcctttggctgtacagaaccaacgccgtgatcctggagggctgcgtatgttgttgggtgagcaccttggccagctcgctgtgtatcgctcagtttgggacttggcagtcacattagcctcagtgttaattccattcgtggcatgaatgctgtaggcttaggtatctcacttcaaggatatgcgctggaccgtgggctcatccagggcaggtcggctggacggtggcatattcgccagccgtgttgggggcatttgatgggttcggcagcgcgtcaggggctgatctctggcgtttcggatcaaatattacagtttgctctcactgttggtcgatctcccgacggatagaagcgaggttcccatgcccaatgctgtcgttggccggcgggcgggggatttttcaactctgtggaacacgcagtaatctgatagattcgactcagccgccttgagcgtcgagcgaaaaagcctgactggtggctgggtcgagctggggtcgagctgcatgcatcgtgcatattattaatcacgtgcagccctcgtgatgctcagctcaaatgtgaggactgcagcaaccgatgcacctgtagcacaaatgtgcgcttgatgcctgactgagcggaatatgcacttcataactgtgtgtaatgaagtcatcttgtgcttaacgggcttctggcgtagcagacgcgatctgttcagaacaaaggacgtgcggtatatttcagcaggggtctggacttggtggagttgcacaatgtgcaagtcgttgatcgaaatcagtcacgctttcaccgattaccaattcctcaacaacccctcccaacctcggttctcttcaatctcgctgctctccccggattatctttcgtatagatgtcatcttcaatttttttttaaatcatttccgctaacattgatgtcttcctgcacgtggccgggatcaggccgcttccaaagttctggcctcaatgctgggctaccctataccgccttgccacctggaaactaggcagctagttgtgagcaaagacttagatctatggttttgaataggaaaaaatgaagatagaaattagtgcattgagataagaagtttgttttcaatatttcacaactcacccttgcaagttgagataaaccgctacaggccattcaaattaccatgtttgcttctttctcattgactactcaacttactgcttgagccatctagatatttgtattgcagagctttttggttgaataatgggaaggtagtcatatgttttagtatagtcttttagtcttttgcaaggataagatccggttgaaactagtgacccttgatactgtatgacgttcctcgtctactgctttcgaaatatgatcagaacccagatgttcaactaaataaatggagcttctaatccctctcgtaaaatttattgaaatgacagggtgttggatcacatcattgttggccacttgtcttactattgtatctgcctcataggagctgaagctgcgaccgagagtagccaacatgatcctaacacaacacttcgaggaaagttcacaaggcacggtcttcaacagatgttccatttttatatctctggcgaatcaaacagctccggacccgcgtgccgtgaggagccgtcgaggtagtctcttggactcaagagctaggttaatataagttgctaacgctacttccgatccagggctgtgaagaaaatgtccgagctcgtacaaagataaggttttactagtatgaataaacccatacgatagacaggttgtccctagtacaaattatgtcttccgtgaaaatgttgcatatatctggcattagtcccgtagtctattcccgccctctcacaacccgccaccccacagtaggaatgagagtacctgtcgttgtggtccctccagcttttgaagcatttgctgtggatcttacaagattggggatatgattgacgatgagcctgcttatcttcccgtgtcgcgaatctttctctacaacgcccgcacttggctgacttcttgtgactgctgtcggcaccactggttggcatgatgatcttgccgttcggtgcgttgtgtatggcaaggttgttggtgtcggctacatttgccggcattacaatcttgccggtgggtgcattgtatatggcaatattgttaccgttagtggaacctggtggcacagaaacctggcctcccggtgcattatgtatgccaaagttgttgttgttccatggatgatctgtgccgatcagctggtttccacctgaagtgccatggtgatatccgttggctccgttgtagtttccatgctcggcccaatcgtttgcaatagggttgggttcattgaaggcatcattggtgtagccgtagactgcgttatcgtttctatagtcgtacccgttggtttcgtcacgagtgcgaaggtggttcctgtggctcctatcatgatttcctctactgcgctttgtagtattggatttgccgggctcactgtatttcgtcgtcttcttgccgccgcttgcgcctgttggcatgtcgactgtgccgtcgttgtatattgcaatgttattgccgccaccgacatctgtcggtatgatgatagtgccttcgttgcaaatagtagttatatgctgaccattgacagttctgttgctgaaattttgtagcgcacgttgggctccggcagggatatgagaggaattattcggcatagtgtctggtggtctacagcgcgacaaaatcgagaatgaggttagtgtgtttgtcgagagcagtgaaaggaacactcaacatttcattctactaatagatctggaaacaggcagcaaggcggcctgaattgaactaaggagtgtgagcgcatttgtaaaatgacataccggcgtcgcgacaaatgaaggggatgaatgtttgggtatttgcgagttctgcccgatataaagcaacggagctgctatcagccaattgaccagggatgttctgcaagccttgggctcgcttacaaaattgacttcccttgtgacacgaggtgtcatgatttcatgcgtgggaggccaatagacgttctgcctcggtgagacgcaacgttgcacgtgaacgttttgggatgccaggtcagcgtcttggtgcccaaccagagagacaaaacaccactggttgtctatcattcgaaagatgcctcatcttcctttgggatgctaaagagatatagggcgacgagctacccacgcaggcggttggccacgagcctgtatcagcattaaaatgactagcagttggttatctggcatgctttcttcgcgctctatttccctaagaagatgattctccaaccgagatcttgggaaactggaaattgatggggatgaatcaagttttgaggcaaggaatgcgaaacaatctctaatgtttgattcgatttgatttgacaaatgcaattccatgcaacgttaaatgtctagctctatcccaagtacacaatagccagcgcaatctctaatgtccatttgtaacattttcaagaatagggaaaccgttatcatcaaagtacacagggaacccagtgcggaatgaatgctgcaaggcggtgcaaatcttacctgcctcgaaggcatcctcggcaagacacgtcaaaggcttgttgaagagaacggcgttggcgaactcggtaatgtcagtgaggaaggtctcagggaagagttggaaggcgtcgggcacagtgcgcttgcgaacgccgtgctgatcgcggatctcaacgttgctcacgccgctgacgatggagtgtgccttcgtgccacagacgcgggttgaatcctcgaaaccgtttgttgtggttctggcgagatgcgtggtccagattttgccgttagagaactcaactaggccatacgcattatcggcatcgccaaacgcagccaggtcgtcgtagacagctcgctggcccatcgcaacgacccttttgacttgcttcttggggtttttaagacctgacttgacatcaagcagataccggccagtgtcaatctgtgatgtagaaagtgctagttagcaaatgtttgcttcgcgccccaggttttatctagaacacaacgctcacatgatggatgcccatatcaagaaagataccgccagagtgtgcggcaaatgccacaaagttacctaagtcgaaggcagaattaagattagtagacgtcacatagtaactagacaatagtaaccggactcttacccgcaggatcttgtacatcactcatgaaagtctcaatggcgtggacgtcaccaagttcgccactctcaactaaagccttcgcttcacggtaagacttgtcatctagggaaagttagcctcataaaatctccaattttcttttggtgaggggggaatggaatttgtagcataggcactcacatcggcgtgtgaaagggaccagaaacttgagatcaggtcgggacgaaactttttcgatcacggcagctgttgtgacgacatccacagaaatgggcttttcgcacatgatatgtaaacccagatcaacagccttgatgatcaggggagcatgggtagcagttgcagtgcaaatgaggatggcctcagctccgctgtgccttaagcattcgtccgggtcggtaaagtgcttgacggtgctggggagattctctgccgcccatttgtcagtgccaggcttggtatcgcagacagcgaccagttcaatcagaggttgctggtaggcaaggatattggcacgaataacacccagacggcccaagccgaatagggcaaatttgaggcgacgaagttcagcaaccattttggtgatatccgatgaacagtgatcctagtttttggacttcgtggggcgttattgttggaaaagatggatgtaatgtggcgctcagggaatgaatatcaagggatggatagaggtgagaatatgacatagacgagtggttgtgcgtgcgatatataatggttggggtattgacatgacccggggagagtaaatagcgatctcagtaatctaggattggcttagccattctcatcacgcggtatttgatgatccccgcctcgagttggagcttcagcatcttggggggtgtccaagggaggcggggaatttggcggcctcgaagtttcgaaaatctttaactgtggcaaatagaatcctagatcgcgatattgagactttggaaaaggaaattctctcggcgagacaacaaagttcccctgcaggcaacaatgctttcaaggcgaacatgtcctcagagtctactgatcgtttgttgtctcctcacaactagcctaataggagctaaaaggaagtgttttggctggacggtattacctgggggaatagatggcaaaccaccaagacaggcaaaaatcggagaggaaatcatggggttagatcctacctcgcagattttactactaagacaagcatgaggtcgccgactctctacatgagagacgtgcgattgaaaccatataccaagattgcaaactacccaaataggaaatttgccgccgagacttggaacgaaacctgcggagatggtgggcacgtgataccccggagctgccccagagtttgggacaagccaaatttatcaattggattgggtgcaagtgtgctatcccgccagggtagggtgtgaaacagactcaacttgctttctctgggaaattccatccgaatatcagaacaaacaccccacccgccctcaacgcttgtgggcgcgcataacctcagcatcgattggcttggtggggtgagctgagggagccgggcagaatttccatttccgggaattgccatactttgagaatctctaagatgtacagcaatcacggcgtttagggattgattggcgggcagggcaatgtaaaacgtacgatgggcatgtgagaggcaaagagttggctgctacttcaagcattgctcttttttaacctctttgctatatatgccatcctccaactctataagaatacctcgagactcagcgtcacaggtacggctttatcaccaactctaccttctcaatcttcttgcctcgagcccatctatgaacacagcgcaatggcttctacagtggttgagtctgtctcctttatcgaaggccgtgctctcgacgccaagtcagaggtcaccgttacacatcatgagatcccaaagccccctgttgcagatgatttcatgtatgacttcaagtataatcatgcactccccaccaccgatgcgcttggtattgagatcccgtccgactgcaatgctcaggtagaagccgaagggatacttaagaaactatcaagtgccatgggaaccggagacgcccaagctttcacagacttgttcctcgaatatggtgagtcaacacctgtcttgaggccttgattctacaacgatgggacaatcacaaaacttgtactcaaatgcgacctaacccattttcatttaggcgtatggcgtgacaaactgtcttacacatgggatttccgcactttcaactttcaacctgccattctcaaagctgcaagcgacttgttcccccaaacaaaggcccgcaaatttgaattcctcgcccctgcgccgaagattgacaggccttaccccgactatgctcagctgcagttcgttgtgtcatatgagacagaaattgttaaggcttctgctgttatcaatgccgtgctcaccaagcaaggctggaagatttacactatgcacactgtcgcggaggaacttctccagtttcccgaacttcctccaactgatgggcatatgactggtttaattagctgggaaaagcagagagctcaagatgtagactctgcgaatcctgaaatccttatcatcggcggtggccaaaagtaggttccttctaatgatgttcactcctcagccagtgtatcgctaacctttggctcttttggtgaagtggactcgctatggcggctcgcctgaaagcgcttgggattgacaacttgatcatcgagaaagatgaaatcggtgacatctggaggaagcgttatgaatacctttcactccatttcccccactggcctgatgctttgccgtacttcccttaccccaaaggctggccgacttacaccccggctcagaagcagggtctgtacatgcagtggtacgcttcggctctggacctcaacatctggaccaagtctaccgtcacagacgctaagcaagacgaggagggcaactggaccgtcacaatcaacaaagaaggcaaggatactcgtgtgcttcaccccaagcagctaattgtagccacttcactttgtggtcttccctccatgcctaccgtaccgggcatgaaggactttaagggtgaaattcgacactccaccgctcacgactcctccaggggcttcaaaaaggtctgcgtggttgggacctcctcttccggcttcgataccgcctttgattgctcccgtcgtggaatcgaagtcacacttcttcagagatccccaacatatgtcatgtcgctgacccattcggtccctcgtgttctcggtgcctatgctccggaccccaagacgggcaacctgcctgtcctcgaagagcaagatcgtctgttcttctccacccccgtgggaccaggagaagagctcggaagacggaatgccaaggtgctcgaagacctagataagcctatgcttgatgcactcaacgctcgcggtctccgtacatggcgtggtcagcgagacaccgggaacgcaacgctcgggcagactcgtaatggtggcttctactttgatgctggtgcttgcgaacacattattaacggcaagatcaaggtcgagcctggctatattgagagcttcacagagggcaaggttatcttgaatggtggccgcgagcgggactttgatctggtcgtctttgccacggggtttacaaacacgattgagtctatccgcggtattcttggtgaagaaatcgccagcagggtcgggcctatttggggtatcgatgaggaaggtgaggcaaagaccgccttcagagaatccggggtaaagaacttgtggataaccgttgggtttttgccccttactcgttatgtatctaagttgattgctttgcgactcaaggcgctgaaggaaggtatttctcctccaccatacaagatttagattagaccagcatttccttttttgactattgggagttgtattgatttactgagctttttacactctttcgtttctgatcgataccaacatcgatgtcgctgctggggtaaccatataggcagattgccatgtgatacacacaccacgggtgccccctctgataaaatcggtctagaactccggaaagttctgatttggtagattaattggctgctcctaattcgattttacggcaccatggataagtttatagcaatttggcctcgaaactaaatttagcgcaaggcacgagatgcactttcccgtgcctgcggacataagtctattaattacgctacaggtatctctttacagaattctcaaactaattagaaaggttccctgtaaattcgagacttgagagcgcaagccatactcttgcttttcgtcgcaagctataaagacagtcttcggaaacctacaaaatgaattttcggacaggaactcactcgatctcatagaagatcaaaaattacccatactagcgctatcaacttcccttcgtatgagaaatcattccttttgggaagaatccgatcatggacatattgagatgaagaagaagcattacctacgccgttagtaacttgattatgtgccgggagtgctaaacgttgaaggcttcctgctcctggatctgacgctgtaccacataggtcagctggtttctacgaatgagtggagcttatgactacttccctccattgctcattgtgggtggcgttgggcgttctgggtggtcgatctgcctcgtaaccccttaaggccgccgatattcgatgctttagcgccggcgaatgctctacctttttagtagtttgtccctggactgacgtagatctcctctctttccccaatgtatggtgggtggattctttatggaccaactccacgttttgagactcgcagtcggcgagtattttcccaattcggtagttgacggagtggatttcagctttcagctccagcagtcatttccatgtgtaaagtgattacaggctaagcgggcacttgctcaacaagctgcgtcaagggcaaggggagaaatgcctaaagcagtatttgtgtagggaaatactacctggaactgagatgtaggtattgatcaactttggtcattctcgatcagggcggatttcttaagatggagtatggaggagagggtttaacagggcctgtgtgtctcctatcccgcccttgggtgacgtgcaagacaacggactagaaattagtctcgacaatataaaaccgagtcgatgtagctcgggctttaaattacgacgacccccaagcaaaggtgacaagtgaacatccagaagccagcctagtcgacttgtcaacttaccaatatacctgttgagttcaaccaaatattgggccattctttctactccaaaatggctccagcttctcacctcaaactcaacacgggagcagcgattccctcagtcggtctcggtatagttgcaaactcctagtgcaattaaataatcacatctctaacgaccatgaaggaacatggcgatcggaacctggtgaggtgcggggggctgttgctttcgccctcaagcaaggataccgccatattgacgcagcgctgtgagtttttttttgatttcgtctcaatttgaaaaatttccctggctaaccaccacacagaatctacggtgggttataatgatcatttgacttagtccttgggagactcatgtagagaccccaagctaataaggttattttgatctctaggaaatgaacatgaggtcggccagggcattaaagacagcggtgttcctcgtgaagagattttcttgactagcaagctttggaatactcaccagcctaatgtcacagagggactccaaaagtctcttgatgcactaggcacagactatctcgacctatacgtatgtctttcagcataaccggcgttctaaaatttctatgcaattcaaaactgacagtcgctaagctgattcactggcctgttcgcttggtccctgtaagtagaatatcccatctctccttgggtataattgcgcatcttcatttgtaagaacattgctaacctacgtagaatgagacaagcgaactccttccagttaaccctgacggtacccgatctgtcgacaggtcgtgggatcagtctgagacttggcgacagatggaggaagtgtacaaatctggcaaggtaaaggctattggcgtggccaattggtctatcccatatctcgaagaactacgcaagacctggaaaattgttcccgccgtcaatcaagtggaactacacccttttctcccccaacataaattgagagagtattgtgccaagtatggcattctcctcgaagcatactctccacttggatcagctggtaagtgttgtattgtttgtcgcgtggtgttcttagactaatttacaatttctctcatccacaggtgctcctctcatgtccgatgatgatattcaagaaatagctaagaaaaacaatgtgtcgccggctacggtgctgattagttatcacgtcaataagggagtagtagttcttcctaagtcggttcacgagaagagaatagtgagcaacaaagacgttgtggaactgtcccaggaagatctaaatctcctagacggcctggctgctaggggtaaggcgaagcgcatcaacactccattgtttggttgggatcttggatttgatgactggtatggaccagttcagcaggacagtctgataagttattcttagataacaatgcatcctgttgtgctacaataatactcaaccttgacaatttattagcacttgaagttattttctcgaaacatggctgcctgtagtggaaagcttagttttggaaacacctgtgcggtcatatctgaagtttatactattactcacctcaagtcaagttatgccttcagcatgtaggataatatcatagagttccttccgattacattacgccgggatctctcgctaaccctactggtaaaggccgagccgtgagctgattataaacatggcgtttcagctattcattagaggccagtggagcagataaaggttcgtatcttctatacttcattatcttccgatgcgccttgcttttttggaatcaatgttgtgggtcacatattcattgaaatcaagtatatatatcacttagagatacggctgcttaccgaattcacattatgcaaacccttttagtcgtgcgcctacaaataatgtgattttctagttcaacaaactcatacaagcatcaatgtgtatgagacaaaatcgggctgtgaatcggtgatacaggtatgtcgagaggtggcggtgatgtcaatttgccaagaaaatcgactcaaatggcgatggagagattagaaaaccgtgcctgccaacgtgcctgtcattgtatgtgtgttattggtagattgaatgctcagttaaaggatctttttgggattcagaaaccactaggccggctggtgtgcgaccaccaaccacacgaaacgggctgtatgcagtattatttcagcctttcggttctgaatgtgagtgattggtaattgtgtgccaatttcaattcgttttagcgctgaccttccgattaaatggcgcatcaggatcctattgctgcaggttgccatatccatctgcaggttgtgaaccaacagcataacccatatttagaaacgggtggctgtgaaatgtgaccctcaatccccttacaaaaggcccgcgcctcattccctcgggcaaggctcactatctcatgaaatttaatctctcaccaacaattatcaagtaaattgaagtagatcaacatgtcaccaactaagacttcaacatcagccgacacccccatcccatccattgagtcagactcttgggtccgagactcatcagaagagacagaatcttcgatcaggcgcttgaggactccgtctgtatctatatcccctcccccggaaacctcatcaaatggggtccgttcagagagccttgggctggaatcacagatgcaaaccatgcggctcgcaagtaaagaccagaggggcctcagcgctggtctcacagacctggctcacgctgtagatgctatccaacgtgagcctaatcagcgcgctgcaacaaccccagccccgcggcgagatcctagcacacctcgacgagccagacgccgttccgggcgatcgccatctgcatcctacagcacacgccacgatgtccatgacgaacctcttcccgaggatatcttccattcgccagcctttcagcaggcttttcgtgatgcgaagggactcacggctgacctcaagactgtgcttgatgatgcgccattgcttcatgatcatgaatcgacaattgccaagcttcatgaagaatctgtcaaattatcttcgtttgaataccccactagtcgaagaattggctttgttggtgactctggcgtcggtatgttcagcgcgcacattttcaaaaaatgtatagatgttaactcgactctgttgtaggaaaaagtagcttgcttaactcccttcttgattataaagatctcgccagagctgtaatttcaccccaaaccatctcttttgttatggcttttacattctaacagcgagaagagcaatagcggggaggcttgcacatgtgttgtgactgaatatcattatcatcaatatgatcacatggatgtccaggtggagttattcaccacccaagaacttgatgagcagctagagcgaatgctcgaggactttcgtcactactccttccacgctgacgaaatgacaacagccgaggaaaaaaaagcagcaaaggacagagctaatgtcgccaaagatactttcaaggcgatgttcaggggccggatgaacaacgactcttttctccttcgaggatctcaacgtgaggtactgcaaacattagtccgctgggctgaggagcagaggccttcacaggcagtgaatttccaacagaatcttagcctcgagcaatgctcagattcattgtttgtcctgtcctcagaacggttatctcgaagcggacccgccatctggcccttcatcaagacaatcaagttcgtattatctatctattattctattcatcgtagtattctgctaacctcacttcccaacagagttttcttgaatgctcatgccctcaaacaaggcctagttcttgtcgacctcccaggtatgttggaaacaacgagccgcgtgctctgcattctagatttcctgaactgactgataattttaaagggttacgtgatttaaactcggcacggagatgcatcactgagcgatatatccttgaatgcaatgaaatatttgtgatttgcaatatcggccgagctgtgaccgatgagggggttcttcacgtattcaacctagcccaacgggcacaactaaagaatgtaggcatcgtgtgcactcgttccgaggtaagtgttgcatcagtcttctcattaagttctataactctaacctataatgactaggacatcgtcccaagtgaagccttgagagactgggatggtgcgcggcaagcgcgtatcaaatctctcatagctgccattgatgaagacacacaataccatggggaattggaggcagagataatggagttagataagcttgaggatgaaggcgacctttctgaggtcgacagagaagagagaagcttgctagggaggagtaaacgacaactcgagtaagtacagctccttcaatttttgggctccaaacttacaaaggtcaacacaggaaaaagatagaggacggaaagtttgagtgagtcaatggccatattcccttcttatgcaagaaaccagacgattaacaaagtgcccataggctcactcagtttctggtcacgacgcgcaatgagtttgtaaccaaaaagctcacccagaagtatgaccaccgtgtagatggccttctccgagtcttctgtgttagcaacaaactctacggcgataggagaagcgaaccaaaggaccgctcatttccctacctcaagttgagtggcatcatcgatctgcggaagcattgtatttcaattgttgcacaagcccaacgacgcgtcgtcacgcagttcatcaatgaccagattccagcattgctttctaagatccaactgtgggttcagtcgggggctaggacggcagatcaagagcgtcgtattgctactattgcagcactggacaatattgagcgtgagctaaggagggtacggataagctgcaaatcacctacaaagtaaacttggcctactaatgcgggtcgtagaatttgcgaaggcacagtcgcccgggacagacaatgcaacgagatttcaataccttagtactcggaagtgagtacgccaagtttctttgagtggtccgaagtaagagcaggctaattatttctaggaatccagttgcttagctggacgcagtttgctgcagacacaagccttgacagaaatggagtaagtagacacatctaggtcaatatcaacctatatcgcgagctaaccttttattagtggcaccatggtgagtattgcatcttgattctccaaagccgaccttaaaaattaatccgaggcctcgaaactgacaatttgctcatcaggctcgtatagtgcctttgttagcaactttggtaaccattccacaccaaaggcaggaactcacgattggaacttggaggccatggagaagatggtggaagatttgaggacaccgtgggagtcactggcttcaacgctatatgagcgccagtctgaacttacacaagctatcgaaacgacaaccgagaccattcaagatggcctaggtatgccacaccttccattgcctgcccactgagaaaagaaattcccgttgtttcgcttcaattgcgccttcttcccgttgactaatttaacttcacgtcgtcctgggcttacatcagctttctctatctgacaaaactaatcaacgtccctagaaaatgaattggacgacaacgatgagagcacgagcgtactacttgaagccctggaagcccagacacggctcctccaaagatcgatggaagtctgctttgaaaagcttactgataagtttctgtaagctcccaatctcgaatcaagatcatccgtggctatttactaagtaggcgtcattgcagattgctacacactgacaccttctccggcatccgaacttcgttgtttggaaaggagatggagccgacatatcgactatgtaaccaagaatacggtaattccccatatgattattaaacgcctttcttcggctcgtattgtgtatctcaagggtcaattctgacatctatactacttataggcaccggaagcgaccgacggcggaaaacgattatgaacaaaggcttttctaatcaagttcttttcagaaatgtgatgaaagcctccaaagaagtattcgaaagcatcacggacgatttgcagagtgaatgggtaaatgcacagaatgactatctcaaactggtggaagatatcctggacctcgtcaggtcagagaaggctgtccgggagagcgagcaggatccaggcttcagagaccgcgtggatgatacgattaggcgagacaatgatgatattaggcggatacaagacgcagttcgagaatgagactcacaagtaggcgtcaagtactcgctcacatgctctaatcaggatttgggagaggaattcttgttgaagatgcagcacgagtaggaacccgagtttcaattagacctaaacaacatgctgaataaatactccctgataaacctaacaataatcgacacgaaaatctcaaacgtataaggttttctttccctcctttttaatagttttctgtctgatttatattctcccgtgggtcgttctaaggctgagctccctacttctcccggggttgtctttcgtacaaagaagaattaatttgtgcctagcgacgattaaaaataatccataccccttcgaagggccaacttgatattacatgcaattgggttgtgacccctttgagtcatggccacattctgttcctcctcccgctctctctgcacctcccggcctgttcccgcaatcgtattcggcagaagaattggactggtaggtagttcggcaactggatagggagattggggactgtcaagctccgggaaagtcgcatacatttcctgaggcgccagtggcggtggctgttcaagttcttgagcagcatggtatggatgctgctgctgcatttgcgcgttctgaacctcccatgtcttcccagtttgggggtcccacatcatgagagttggtgacctggaggattgcgtaaaatctaagttcttcgtccatggcgtatcaggagctacctcggtttggatcgacggttcgggttcgactctggtccacagcccgttaggtgccttcttggtgctgattgcgaagacaaggcagaggatgataaaaccaggccaagtcgagaatataacatcaataagactcagaaatatcaatcgtgagccatttccagggttggctgatatcaataagctgtaggtggtacacacaacgaacagaaaacagcaaacaaggaggaaaactgaggcctggggtgaattagccagtccacactaacacctagatttgagaaccactgcggtttctgaatatggaaatgccaaccaacctggttcagctcggccactcctcgagtcctgagcttgactgtgatggcccaactaccaactagcagtgacgcggtgcatatgcagacttgatacgccatatttactccgaacacaggcgatgaaggtgagatagtataataagaaatagtcgcgccgacatttgcggctgtaaggagtgcgagtacaattccaactattggaatactgcgtctgagtactctttcggtcggtgttaattcgctcagattggcgacgagaattccaatgcagaggtgtgagagtaggagcagtatcaatacgtcggtgagttgtgtgaggagtagatgtacggcggtcaagccgataatcgctctgatagctgacaagctgatagttgacatatccgaggacgagctaccaccgctgttggatacgatgaacgctgctaggtcaaaaagacgcgacctacacggtaagtggtattgtgttagattttttgccatctcccgcagcatagaatgtcactggtgtgccgtggaaccatggccacgacaggatagaactcacacgaagaaggagcataaccctattcgcaaatacagaaaactatgacgcgcagcatcgccgtgtcgatgagagaggcggatggcgcagccaaacacgacgacagaagccaggcccgtgaccccaatgagcacctcccggcctgtcaacacactggagtcccggtccatgatggcatccgttcaccttggaggatccgcgcttgactgtcgggcaacaaaaggatttttggcatccagaaagagtgacaatgaagacgtgacggatctccgcgtagaaaggaacggggaaaggtgtgggggatggcgaggtagtacgttgaagtaggtaataagacatcctgaagggcagcaatgtaggcactgaaactgtgttagctcgggggttggaagcaagacatggtaagcctttgggagcatgttttttacctgaaagcaacataaatggaaatctgcccagaaaaggaatcattggcatgtcgatctaagcaaataactgagtagcaaagaattattttggctttggaagcgttttgccttggtattgtgacatcgatgggttaatcacaagacagcctgtttcatttttccacctcagccgcagtaagccaactcttgctcttaccattcgggaagatgagagtccgagtgtctgagaatgtctcaaagaatacacaggggtctacgtcgatcagaaaaacagacttcacacgcgtgactggccagtgcatagctcggcccgacgatggaaggatagtgccgcaattgtaaccggcgctatttcatcatgcataaactcttgtttgactctggtataagagatatctcagtgctcgacagaaattttagggaacccggggattgtaatccaatacatctagaaactgtcaatgcttcctgcaaacaagtgaacgagatttttgtatgcaaactttgcgctatgtctataaatactcctcggtctgaggattccaatattaataagtcataccgaactcatcggggcaggcatctactacacccaaggtgaaaccgttgccaagcccaacaggatccgttctggatgtctggtcgttataaaaccgggctcacatattaatgtaattgtctagcatctgaatacaagcatgctcataataaaagtcaccccgcagttgtgtgtagaatgctacatggagatttcggctggcctgcctgcaacatctcccccatatgtcccctgggaatagaaaatactcgcgggctaaaaatagtttcagtgctctagcaacgcagatgctaacacggtacgtatcaggaaaaaagaccccaaaggcggcttctcctacgatttcgaagcaaaaaatgtgcaagctcatcccaaaattcccgagaggccacctttgccctcccgttactgtccagcaaagaaacctcctcttcaatacttctacccttcttctgtcgacacctacacgttgggtcactaagggatgcccctgattcgagcaatagtctgactagttcaatcctctgacgcgagaggtcgcccatgagaagcctccaactcgctgagtagtgagccaaatcttcgtttgtgcggctcacatagaattgccacccgaaaatcgtattttccagcagagaacgtctgtttggctcggattttagaaggcctttattagtcttcagtttggctttgacgtagggcacaacagcgaactgtgccgcgattcccacggcagaattctcaatgcagaacggtaaattgtcctgcgtccatgaccaatgctttccagtgttggacttattgctagatgagcggccttgctttcctccgcgattaagccatcggtttgatttagtcgcagtcgagtccgatttcgacaaattcgcgtcaaatatgtagccgcgctttccaagatctgcagctcgctcgcaaagagctgcatcgaaatcatcaaccgcttgaacaagggattcagagaagtattcattcacctgagacgcatatagaaatcctaggataactatatcccaaaatgcaagctgcgaaaaccccagatggataaatagccgtggtttcgaaatcaccgttgtgagcacttggagcagaaccagttccggggcgaagtttgttaatgctttgcgaggtgtcgatagcatggattcttgcaggacccagtctcgtgcagttctatgaagaaatgtgacgatcccgtcgtcatccacttccagaaggccttttgttgagctatccaagcgtcgttctaatattttgacgatattttctttgtgctcctctgtgaaaaaatctccgttcggcagactctccccgtctgctatccagagcgatatggcgtgcaagggccttagagatgcaactgtaagctggtagtatcgcgtagagtttttcaaatcttgaggatcgaccttttccctcatccgactgtagagctggaacaagtctgttggcaggtcatcgacaacagcttgcaaatcggccagacttctacccttagacagactgtacaggaggtctcggacgacgatgaagacccacaggaacactccctgtgccttgtttgctatatcatagagcagggccccggcctggtcggggaaaagtccttgtcgttctcgaaatgctttgctagattggaaatttcctatgatataggcctcgatatcactctgggtgaggtattgcattgcaagcctgggatattcatcaaatgcgtccgtgaactcggtcaaaggtcgactgccaaggcatattttgacgccatatcttgtgacaagctcttgaatgaatgagattagagtacttggatctccgctgaattcatcaagtccgtctaggatgagcgcgagcttcaacgaatgtccattcagcgacgccaagttgaagaatgcctcttgcaattctgcccaactccaagccggcgccggggtttctaggccacgtaggacttgatacaccgcccatcgtcgtgggagtacgattggcgtgaggtcgggcattgattctaggcactggtagagtagtgttcgcaataacccctctcgcgacttttgcaagttattatgccctgcttcccagaagtagaagtggccaaggagtaaggaaaatggggctgcccatttttggaggctctttctagtccgggaatcgcggacgatgaaattcatcagagttgacttcccagagcctggttttcccgtgatccaatataccaaacacggatcttgaagccaattggtgaagttgttccttcccttaagcatctcgttgtttccgtcgtgaacctcatcatcgcgctcgaaaatccaacgataagtgtcgtcgtatggcttgggtattgacctctccctccgagaaatgtcagagaaactcaggctttttactatttgtttatggatttggttattgagattattgcttttagaactcagatgattcgtgtcctcaatgggcgtatcggatgggtgccaatctgactcccatagtcttctgaaaaggacattcctgttcccaggtcccacggtgtcatcctctgaggagatcttgtcgagttcagacgcgaattggtccagtttgctgttggttctatcgattttctgcgttaacttggagatctggtgctccaagctctcacccatcccatttccgcgggctcgatctctttccctgcatgaattgttagttcataactgcaaggtacactcatctgcaccggcacataccacaaggagaccagcattgccatggtcatttccgaccgtatctgctgtaatcgcttctcgatgttttgcaagttccctttcgaccacatggccttgagagcgacagtgacactatttttcgccatcatagctttcgatccgcctccctgggcctggagataggccagagcgctattgacttctgctgtgattgactcgcattcctggcagagtctgacgagcgactcgtcggatggcacaagcgcttgagacgtcgctgtatctagtgcatcgctaacctgggtactgatctttcccaggtctttgacgagcgtagataattggaagttttccgaggatataccctctggcgaccgatagatttcaatggactctgagaccaggctgtaacagaaatcgacaaacgtcacaactgtgccagccactcggaatgcagagacgggatccatgatgtcgagcgcttgaagaatgaacgtcaattgtcagagggcttgaggctgagcccatgcgaccagcctcaatgctaccaaagcctcgacccaggtactagatagtgatttggcgcttggctgcatcaattgggagctagaagcttggggaaactaggtgtgttcgatttctttaccgccagctgcaatggctgtgcgaaatttgcaatagcgactggggtatgcaggaaatttgatactggatctcggctgacccctcactcatgaggcagggtaggattggcaggggtgagatatgctattctaggaaacatcttcatggacgaccaaaagcaggaggagttccttgaatgaattcctgtaggtaaaaacggtatctatagacaatacttcaattgctctatcaactccaacttctaagacagccctaccattcatggagaatcgcagctctggaaactaatcaggccttttggtcgacttctgccgtctccggtgaaacatcgcgggaagacgtgccattgacaaggtcttttagcccaggaagagcaacaacggtgatggcaagggtaatctcgagcatgctcattggatctatgtttgggggcgtggtcagcatacatactcgtatttacagttcgtgtgtataagagcgccaacttacaaacgaggttttcctgccctgtgccgatcttgaggcacgcaaagcgcacaatggtagtgaagatggtcaaggtaccgaggacaaaggtgagggtgactcccttggaaggtttcagcacaccttggattaataggacaaccgggagggcatagactacagggagaggatgtcagctgtgaatcacggatagattttctctaacaagcgaatgaaataaataacgtaccgacgagataacaggccaaattcagggtgaagttgagaatgaagggtgctgtggcatagaagacgctgcaggcgccctcctcctgagaccactggacagaaacgtctttgccgcaatagaaagtgtcatcccagaggatggtcatgtagcaaagacagacgaaaataacagcacaccaaagggtcctgcgcatgccttttgtgatgttggggacgaagtagccccagtagaaggccaacatgctcatcttagggaaacccatcccaacatcgtaaaagtaattggaagcgaaggaaatctgttccagacaatagttagtgaatatgaggtctgtttacccagaagagaagacgaatccaggagctgtgtagcaatattccgcaccttggaaagtgtcacggacggctcccactcgtcaagtacaccaatctggtaggtcagggtgtcgcaaatgatgagagcgagtgcatcaagagcggacagaacgaggagccagtcagacaagtcaagtttttgacgtaggcggaagaggcgcgtgtagattcgcaaggcaacaaatacgtaagaagcggcgagtagaatccattccgatatctgggcgttgagtatcagttagacagtcttgtttcctcctgggcattgaatctctcaccatgcaatcttttccgtcaatgaaatacgccatgctgtcaaaagtccctggatgccaccagatcgaaggtgtatgtgggtggtttgtaagcgtggaagaagcttgactgcagaagaaggaagggagaagagcaaaaaggcagagaaattataaaccagtgaaaataataagtggaaatattccaattttccttgctacagcacagggatgggaaataaacagaaagaattgcatgggagacatgggagtgtcgcatcaccgtggccatatgcagcttgtaaaccaacaaccaacccaaggttgcactcaacagcgggcagctagaggccatcagaatttctgggacttttgctacgcctacatcacaactggggttttctatgaggcacagtggtctgacttggtcgtatcgatacgaccccaacggtatttatgtttccggccaacaagggcctgcagcttggtctgcttcattgctgtggcatctttctgaagcacccaacagcataaactagcctgacgacaggcgtagaggaaattgagctggatgacgaaccgatttggaagatgagccgggaatggtcggagacccagtccgaaccccctgttctgacagtgctgcaacgatgcatgttttcgtctgggcccgctgtgtgattgctacagcctacatgacctcgtgtagtgttattaagtcacagcaatagaacgtgtacctggtatattcctatagggaaactggaaaaaaagaacgacggggattctatgtatctacatggcggttctgttttacctaagatcttatatcctctcgtctcaaagatgatacactaactcgctccgtcttgtaaatcccgccgcgcccttgtgggaggtcttgtagttctacttcgctgcccgagggccctactgtagcgacgtttgtagaagtcacataagcatcccggccggatgatagtttgatgtgaccggtactcatcgcataattcttgtatgcctttccgtgagacttgttgctcgtcgcgcccgtcttcgacgagtgcgtctcgacgcggcggatgagtgatctgagggcaggtagacacacgactataatggcagcaaccatttccgccatggaaagcacgtctagtggtccagttagatttttattcaatgtctcgggcattctatttcaggcagggaaaagtagagcgtcaaaggagggttcaaactgacaaacattcgtccaggcatggatagcttgcatggtggcaaatctaacgacgctggcggccacagtgacgccgcccaaagaaaaggtgacgatcaggccgatgagatatcgcttgttgattcgcagtcccggcagcagaaagaaaggtatagaaaagcctagcatgtggccgtaaaataagaatcgatccaattgtaacatgcatatgcatccacatacctagtaagtccgcaacgatgctgaggacccagtcgattcgagaaacattcatcgaatcaaaagtggcacaatctccattgggatcccagttgactgccacataagagccgcaccagaaagtgtccaagaagcaggtagtcacgaagaagaccacagtcacgcctgtaataacatagaggtacttgcgtaagttgggcatcatattcctcggcgggaccagcttgtaataaaacgcaagcaaagccatctttgggaaataaatgcccgcgtcgtaaaagtagtttccagcaaatgcaagcttcatcagtgcgatatcgacgtcgacgggcgtctcaggcgcatcggggtcatagtcgtccattcctcctaacttgtatgtcatcgcgtcgctgacgaataaggcgatagcatctgcccccgaggcaataagtaaccagtcgctgagggtcaggcgagttcgggacaagacgagacgcagaaacagtcgtgagaggatgaatatcagggcgatgctcaggagtgtggcctcgacgggctattgcaaatcataatgttagttagattgatttctcgtttgtggatctccttccctgatgatcgtcgacagagtgttgagcactaaactgtgcgtgcaacatggcgatgtgaaacagagttgaaaggacataccacaaccgccttcttgttgatgcctttccccatcacaaccggtgtatgaattagaaggtataagattgttttgtattctgggctgaaggctgaacgaaccccttctattactatatcatcccctcggtctgcgtccaccccagaagcgagcacgccgcagctgcgcacattattgccgcttcattttttacaagttaagcgttacgccttcttggcctctcggtctgttggttcagcgtcagtaaacgagagctcccctgaaaccgtacgaggaacttgcattaactgctgtgtatgcatgcaaccacacgttgacaagggccattcatgcaggttgttggtagctactgagggacagcatgtccagaaagagcgcatgccctccgatccttgttcgaatgagagcctcaacgtgaacgaattactaccaatacggagtccagtagatcccatgtcaagatactgtattacttcatcctaccagcccgttgacccggtcaaaggaccaaccgcatatgtgcttaaaggaccgcgggccgagagaaggtcacctcgcatcgggtaatgtgtgacaacccctgcaccgacggatggtaagcacactctcgcaagcttcgacacttttctaaactatcggagtatcggacccgaaaagcaaggaatggtccgggttgtgggaagctttccgctgtgtaacccccaatgctcatcactgtcgtatggtgatgtgaccgggccccttgtccgctctccgagctgagtcttgatctccacagaggcaaggcatcaatatttgtcccgccggcgcgcgcatccctgagccaaccgcgcccccctaatgaacattcaggcaaggcctcgtcacatcggacatgggttcgagcactgacactctgacaggatctctctatgtttggatggcgtatcagaactactctgagcatggaggtgtatcacttcttcagatatagagatgtctgaaatttattgagggaaataggcaactaaatttaacgcggcagcatcaattacatgtctgtcatttcggagtaagcatagcatctaatcgacctcgttcttacaggcttgttcaagcaccccagagccaacatccaatggggccaatgatgccacaggtctcgatgacaaatacataagggcgcgcttcctattaggctcgttcccaattaccgtaagcggagcagtgatgtaagataacacctgccgaattctatagacagcctacagagagagccaacagcagatttcataattccaattatgccacggctaaacaacatcctatcaaacgatcacaacaaagtctacttctcttctttgttaggagcaagataatatccgctgctatcaacaactaaatcgagtccgccacaatcgatgggtatccaattggcatctttgccaagaaagtgttgggtgactgtcaagccccttcattaataattgtacagatctgagcttaacctaattgtgcaaattcccaattcccgtagtccaactacaacctttgattcattcattcattgaacgcctctattccagcatagccttgagaacctggatctgctccagcacacctgctcggctggtgccaccttgggcagatcgtgactcaacactagcttcataattgaaagcatccataatatcatccgggaatcgcccatcgatagccttcatctgctcgagcgagagcttatccatcggaatacctagctcctcgctctttgctaccactcgtcctgaaatatggtgtgtttcgcggaagggcacgccaatcctgaccaatgcatcggcaatgtccgtggcaatcatagatgggtccagtgaagctagcatccgctctggtcgcagagtaagggtgctaaggatgccatttgcgatctgtacactgtcagagacagttttgacatggctgatcatcgcctggaggctctcctgataatccttattatatgtgcttggcaagcccttggtcgtgcaaaaaagaccagctagatgaccgaaagacgtgcctgccttgcccctgagcaactcggcggcatctggattcttcttttgcggcatcaggctgctgcccgtactgtaggcatcggcaatagtgatgaacgagaattcagaacttgagtacaagatcaagtcctcactccaccttgagagatgtcccatgaacatagtgccccacatcaggaactcggtaacgaagtctcggtcactgacggattgcatggaattgtacgtgataccttcgaagccaagctccttcgccatcatctggcgatcaataccaaaggcattaccagcaagcgcaccagcaccgagtgggctacattccatattagcaagagcatgcttcgtcagatatgagagagcctacctcctgttgatgcgcttcaagacctccctcaaacgctccaagtcacttgcaaagttgaacccgtatgaaaggagccagtgggaaaatctgactgccatagctcgttgtaaatgcgtgtacccaggcatgatgtgatcactgttcgaattagaagggatcgccttgtaaggagtaggagaactggtgccagactcacatatcagcctcagcacgagctgtcaaaacgcgaaggaaagcaatgagatgaccttcaatctcgcgaatgcgctcgcgcaaccacattcgcatatcaacgacaacttgctcgtttcggctacgaccggtatgcaacttcccgccaacttctttaccagcaatttcacatagccgacgctcgttcgcagtatgaatcttgtgattcgattagcaaaggtatttcaggtttcaagaaatagtgccttacgtcctcatcattaggcttaatctcaaaggtgcctgcctcccactccttcatcacttctcggagaccatgttcaatcttggcgaactcgtcgtcagagataatgccagccttggcgttggcacgggcgaaggcaatactgccaaggatgtcttccttgtagaggaccttatcgatggagatactctcgttatactggtgcataaggggatcaataccgcctatcattcataatatcactcagtataagagatccaggagcttcatcaacgagaagctaccaacctgtaaagcgcccaccccagagcataccctgagcaggagcgttgttggcggccatgatgggcttggctgcgggtgtcgtatgaggtaattggatcaataccttctcgaaaagtagacggcgtctgatggagtcaattggtgctgggtcaatgggtcaatggcgaagctgatttaagaatctagtcgacgtagagggatggagtcacaagggagcaaattttccgacatcggccgtcagttgagtgtggtgcctaatgactcacgtgattcccatgttaaagcccgcattaagcgacccacatctttccttatcatccatcgttcgtgaataatgaattaccctacaactgatgcaactctgcaatgtatttggcgaactaaattttccgatataacgtggatggtcgtcaaaagaggaatgtgggtaactgatatgggcctttctgcgctggagccttgataaatcacttcaaccaatccgttaatccccctcttatgaagcgtctatctgcgtgagaccctcctccaattcaaacagattctttttgtagacacttccacaatttgtagcggctaggcgtggagatgtggagacgaggtgtttttagcgatgtgttaaggtgttcccgcaagcgcccgacagtgtagctggctttccctgcacaggcgttttaaaggttgaaatttgaggatctgtgcgagttagcgggcgggttttccggcaatcccagggtatagggtaggccggttttagctagcgaagacatacccctaggtagttgattacttcccaatagggtgttacctagatgaatattggatattaccagttacttaccaccacaatttgtagcatagctagtccagcttactacaataccaccaactttcaattctcaatggaaccgattggggcattcgcacgcgccaatcgcaggtgtcaggagaaagaatgccaacgagatgaacaccgctgagaggaaacagccgagaagcgtgccagcaagaacggtcacaagcacaactacgttgcacccagtggcaaaatccacccaaaactgtctcattaacggttcatctactcgaactcaaaaattccaggattatgagcctctttgcggacctctcggctgcccagtctgtcgcttagccagagcagattccaacagaagggttaattggcgccatcacgcaattgaccttttcagctctagtatatttgatgcaatgatgagctggcagagaactacatcaagggcctagggtatcttccttcaatgatagcgaacagatgcgacccaagttcctggtaggccttatcttgaagagcaatgataaccttagatacccaattattctgagcgattgacagagcgtaaagctataaatgcccacaaaccaggatagacattgtaagcactatgtgccattaatgctagtgtcatccgtgcccaaaacctaatgtgcttggatacagaaagttcattggagtagtaagcttgggtaccaagtctgcccatatgacacattgcataattgatcatgagatgaattttcattaacacaagtggatgtgataacgttaggtatcgaagagtgaaggtggtgatattttgggcaccgtcgtgtgtcatggaaccaatcacactcagcatgcgttggcaatgcagtgctaatcactaacccaaacttttgccctgtctttcgggtaacaattgggtttgtcgtcactgtaaactgtgaattattgtttagctggatacatatgattaaaaaacaaactctgatcccaggtcccgccatcaaagcgttcgatattcatacttcctgaacgctgtggaattaatcactgcgcgtcatttgcgattatacagccattgttggctttggatttatcttcaacagaggtctggaaaaagctgtgcaaattttcagctacacgactaacaatgacggcagatgtcccagaaatatgcagaggaacgggccggcagcccccttgctcgcctacaatacctcccccatatcgccgccaaggaaggaaacgatgctgctctgtcacttattctgaccaagtccagagagtccagccctggtagaggaaccttcttgagctttctgaatcagaaggatgacgacggtaacactgccttgcaccttgccacggagagcggccacatcaacgccatacacaaactcctatgtgccggggctgaggtggaccactgcgacgacaaatatcacactgcacttcatattgctgcgaggaaaggcaatgtggagattattcagcttcttctcgattttggatccaacgcaagagcgcgcgattctaatatgagaacgcccctccatctggccgcgctcgccggccatactgatgcggcttccttcctcattggaaaaggcaaggaggcagttgatatggaggacatggactctcaaactcctttgttctatgcggccaagaaccatcatctcgacgtggctaaagcgctgagagatgccggcgccaacgtcaacgcgaggaaatacggcttgcccctcttgcatcagatggcgagctttaatgacgcggatgcaatagacatactcattgaagtcgggggggacaaagagctagtcgatgctagtcatcggtccgctctctatgtggcagctcaggaaggctgccggaatgcatttgcttcactgctcaagcatgagatgaagaaggaagacgatgatagtgacatgggctgggttctccttcgacgcgctgttgaagatgccagcctggatgctgttgagctccttctcaagtctgagttccggaagaagtacatcgaagacgacacagggatggagaatctcctctatatctcggcaagaagaaatctcgccaagattgctaagcttctccagagctctcttacgcagcttagggagccagcaggaaataggctctgggaggttctacaccgagccattcgagatggcgatccaagtgcggtggctgtcttatgcgacattggcatcgacaaggaggcgagggacagtgcaggtcggaatgccgtctatcttgccgctgagatgcatcatgcagcggtcgtcgaagtcctgaagcagaagcagacagacttcgaggccccagatgatgaaggggagaccctcctgcatcgtgctatcagggaaagtaatgctgttgccctggagatcctggtggcctcaggtgcgccccttgactcggtcgataatgaaggcaagacgccgttgcatcacgcagcaatcaaggaatctcgcgctgttgaaattctcgttggcgctatggctaatgtgaataaggaggaccaagatggcagaacccctcttcatcacgccgttgctcgagtgggatatgaggctttgaaaatagtcgacatgctcctgaggaatggtggtaggatcttcactcaggataagaagaaggaaacgctactacacacggcagcagcgagcggagactatcatattctgactttactctttgatagccggaaggtccagaagtattaccaggagctcgtgaatgaagagggccaaacagctcttcatgtcgccgcaaagcatgggaatctcgaggctgtcctggtacttgttactcaaggactaagcactgaggcattggacagttctggtcagacacccattgagctagccatcaaggggggacattccagagtcgtcaatcaacttctggctcttgaaaagtggtccgccaagggcggtgatcaggcccgtccctcctcctaccttgccatgctgagcggcaatcgagagacagttgacttcgttattaattctaaagcgcctgaactggtacgggtagaacccatttcgaattgaaccccgccactaacacgttttcaatacaggaatctatctatctagaaagattgtatttggcttccacccggagatttacccagcgaggtttgaagggcctagacatcaacgaaacgcacctttcctatggagaggcaaccaacaacgctttgagttggggtctatcgcctagggctattccgtggatgatgaaactaggtttttatgactatgtggtcttatgtggtacgtggtttcctgtccgcctgtgtcctcttccgttgctctttggcttacaattgtgtctttagatgatagtcaatcagtccatgacaacgagctggttggaaccgtcaaaaatacattggatgaaattgctaagatctcagagtcattcacggaatcccgaataactgtacaattcgttaacgctgagaaatcctggcagagcaactctggtgagagtttacggcaggtagctgatgaagcgctacgcactcggcgcgaaggtcttgctctaggcacgcagttagaagccaagatcgtgaagcccatggttcttgatagaatcgatgcagacgccttcaataagcccttggtcatttttgtggtcaccaacggaaaggtatgtgaataagatcgattttctcggaccttgaaatggctaacaatttgcttcagccggagagcgaagaagaagaagccaagttctttgaagtcatcacacaatgctctgatcgcgtcgaagcaaagtctctcggaaagtcgagtgtcatatttgttatgtcggggctggctggcgagcctgagcgtggagagcttgtcgacggtatcaaaaagcacaaaggagccaaagacttgatatactctgtcacagagaccctcagtgagctgatggaatttgggcaagagcctgagctaacacatgggcctaccagaaaggcaagtcttacactgttcatgaatgttattatctacacactaactgttatgatctttactgcagttatgtgagtttttcctagcggccctagagaagcgggatgtcacaactagaacaaacgcaaatgggtggaaagccgagagtggtcaatgtaacgaatagttgcatctcggggggcttttatatcgccaggggttatcaacccaacgctcgtttgaatgaatattttcctatgtatttaactgcacaagagggggtgtttatcggcaccagtggctttaggtatagccacacattgaaatatcataataaagccagatgacactttatgcctgccagcagatatcgaaggcatgtccatgccgcctgagtcttaagtcttcagtagtacttttctgacaatcctgagagtaaattttcccgccagtgccatagagcagcataagtagcaccgggtccaacaatgatttggccggctaagaccataaatgttactttgaatgcatgcaatgttgaaatatatcccgtgccacggagattccagacagtgtgaagcaagaaaatgaagagggatgccgaagtgaagatgagatcccagatcaactgaaagtatgcgccttcggaagcatcaggcatagacctgagaaaaggaaggtctgacgactgcaggatgccagagaaatgccctttcagctgtacagcagcgaaaatcacggttccaaggtggattgcacccaaggagacgtataagaggatgtaaagtctattaagatacacaacgtcgagatttcgtataccaacgacggcactcttatcagaagcgccctctttcaaagtcgactgggaatgtttcagcccttcgatgctgttagaacgggagtgggccgtaaacagtgctgttaatactccagtatagacaggaacagactgcaaaaagtcaaacgaaatccgaattgattgctctttgaagttcggcaccaccaagagcgcagtagcgacgaagtagacaatgaagagagctagagtggccgccttggcggcggaggacggtactggtcgtccgatgatcgtactgtcacctaacaccatatgaaaaataaagtataaagaggttgccaagccaagtcttttcatcttgtaggcaacccagaataaaattggcctttaacgagtcagaagtcttttcgttccttaagggttgaaagatgtagacaaaccagcgaataatacttctttgatgaccaagtcgataaccttcgatcgtccagatagtaaccagagatatcaaaattaatattgtttcaataaacgccaggaccttatcgatatcctgttccaaaatcaggtgagagtaggtgggcatcactgttgaccgaatttggtccacgagaaaggtcacatatgtctgttgtaacccccaacctgcaacattgtcaaaactaccccgaagacctgagaggttgtacaactctcttgagcaaaagaggatgtaacccgtcatcatgatagacagccatttcaacgtccacatcttgcgaataggtcgcgcaggcagctcatcagtgaacgggacaagccgtgatcgtttgggcgggggggattcatgaaggctgatcgcgcctactactctttttttgagatgtcccaggtcatattcaagcccaccaacagtccctagaaagccagggaccaggcctgacataggatgatcattcgccagcagcctctgttggtcgttagcagctttgaccagcccctttactcgggtctcaaagcggcgttgcgtccgtgtaagcatggaatcatattcgttgttcgacatagtccttggattgtttcgtctgagcaaactttgaagctcattgacaaacgcagccccagactcgagcgctgacatacccccctgccctgcgatagggttatgctgtatcaatcaatcctgtcagccaagcgaaactaactgagggtccttccgggcggtcaccttgtgggccgagtctcccaacagcatgatcctgccgaagtgccaacgtttgaaaacgtgctccacgaggggagtgagtgtagagtagagacggctctcatagagatcgccgaaagtatgtctctcagcaatcggatcacgtaggtgtttctcaaccagtgacgtctcttcttctttcgtataccgaggtatccggtctctttttaccaagccattgcctgtgttcacgaacagaaaccagtaggtccgtttacctggccctggggatatgagatatgaatgcccatccccacagacaaattcgttggaatcgaggccctcggacatctcggaaattccaaagacgcatttatacctgcaggaaacgactaggttcacgttccacgtcagcttttctcggcacttgtgtatttgttgggggaatcctacgagattcccggtcctggaggaagacccctggctgaatgcattcaccgatacgccacatctcctctcttactctgctgtgaacaccatctgcgcccaccagaatgtcaccttcaaatgtttctccatcggcggtagtaaccttcactccatgctcccccatatccacgttttcaaccttctttccgaggtgaaccctatccttgtgttttaaattttcgaacaggatttggagaaggcttcgtcgatcgatgaagataaaagggtatccgtgacgcttctcaagatgatcgcccattgccggactgaagcatataactcgacccttggcatcgcggttagtgttgctcatcggatggtaaccccatgtggctcgaatggcctcatagacacccatctgatcaagaattcgcaacccatttgggaacagaccaatgctggctccaacctgcggtgcaatttcgctgtgtgactcgagcagaacccagtcaatttcggccatttccagcatgttggcaaggccgaggccggcgatgccaccaccggcgatgacaactttgaagtccttgtcaaccattatctcgtttgcagaagaaactttttttaacaatagccacaaagaagaaaatacccaggcagaatataggtcttctgagaggattgcaagctcattatctaggtatgtcagaaaatgttgagcgcgctaatgtcttgttggcggacgtatatcccagcttatctccgcctctcatgaattgcctcaatgcttacacaaccccatttaaaatctgcaactgataaacagggttctaaaaagtgcagagccggtttagagacgtaggaagaatctgcacaaaaaggcttcgcttcgaggacaagatggtgtcgctttcgaatcattaacaccacagaatttgtttgtgctattccttgcctacctccagtgccctagaatttatttagaatactgttggtatactgttggtaaatgctatgtaatgaacaataacggtggtcacgaaactccaggttcccgtcatattgtttattggattctggtactagctgaacgttgcggctttagagcaggctaacatcgtctaggccaaagacaccccctatactagaaaaatcgcaccacagtgccacagatagattgcttattcctgtggttgaagctgtaaaactcccggataacagatagtagcgaggcgggttgcctccgcccgcgcccgaataaatggtcgccagcgcgaaggggttcgcgtcgatggaggcctgcaagtagcagctactcaatggcaggtccagcacactatagaacgccttaaaggagtactttatcccgcttgtcaagctgacaggctgagagagtgttgtggggttctcatcaccgctgttaccgatctggctgtttccgcatacatgtcagcttgaatcattcgccaggtagttgtaagagagaattgcttacgcaaatttgtcgccgctgtgagcttcgaacgggaaattgactgtgctttcctcgttgtcggttatcctcacgtagcccgaaccaggcgcaaccacccaggggctagtatttccagactcgaagccaccgttggaaattagctctattggggttggcggagtggtgcttggaacggaggtggaagtgcttgaggcaagacagctacacgcactggagagccgggaagggccacatgatgcgaactgggagggcgctacagttgcactgtatcaaatcagttagctttttgggcgagttgagcgacaaggaaccgactgactgatcaaggtactcgctacagaactcagttgctgttgccgtctgataggacttgattgcacgatagcaattgtccgcatgacagttacccgtgacaaaaggaacggccaagagaaacagagttgcggagcagataaacatgtcaatagcttgaggcctgggtaaaactgtctctgtggtttgggttcttctaacctcagactcggggaaagtggcggttttacggggtggaatacacacttcgattaagcaatacgagctgcagtctgaacaaagacccaaggaaatattccccgcatcgctatatgatgactgtaatggctctagcgcggagctaatgtataaaatattgaaccgtattcatttgttcaaggattcatctttcagctcagctaaatattaatacgcagcctaattgatccacgcaccagaccttaccaacctcctttctacaaaccttgcttacacgagtggaaacacccacgactgattgagtgctgtgatctcgtgttattttcaatactcaacttcggagcaaaatcgattcagcctcattgctaccacgaagactaagtgtgtgtggagatacgaacagcccattcaaggtattgaatgcggtcttccctacatgtactccgtttgcaaaaataagcgaaagtctccaagcgataaaatgtgccttggcatctaataattcatgcagctgcttccgaaaatgggtcaaccctcacaaataactgaagcatgaccatacagatagattaccatttggcgagccgaattccgagggctaagcatcaagtcacgcggacaaaagggaaagtgtaaccaatcctcgtccatctcagggcagtgggatttctatacctcgaacttctaagttgggctgtgatcagcaatccccctttggtttccaaccaggtgttcctacaataccaatgaaggcgaactgtaaacgagtctatacagtcagcgtaaggagtgttctgattaccccgcacaattagatctactatatatgaagtgcaacgggcagtgcccatatgttttggtctcgttgatcgtaattgtttttttccttactatatatttgtagattatggtaatatcgcttctcatggacttttcatcgttctctcacggctcaaggaaagctttcaatctcctaagtagaagaaaaaccgacagctgcagagataggaagatgactgcttgacgcccttgatttgcaaatgaattgattgaaactctttgccttctgatatgattcagaaatgacgagacagaaaatgtccctcacaagccaatcacccaactttgcgcccaagtcagttgtatcccactcgagtggaatgtaattagtcatgaaattatagtcaaaggcatagggtttcaattcgcaaggattcagacgcttactatgtctaattgttcactcctgtgtgagatgatgaattctgaataggtcgaagtcaactggtgcgattaccaatcaactcgtttgaaatagcaacatcatattgaatttctaatacaatgtcgttcttttgagcgtttcaagatcttctcagagtatgcacaagtccttaagatcttatatatatcacctcctatcatcgtgatatgtattttccaccgacttttcctacacacactcaaaggaacatgaaacacaacgataagtatttcgttaaacttcggcggtatcatggcactagcctcaatcgcacttattattggctctggcccacgagttggcgcttccgttgccaaggcattcgccagcaaaggctaacaagtggcctttgcctcgagacatggggaccgggacctcgctcaaggcagatttcgccaatcccgaatcaatcgcgcctctgtttgatgcagtgaaaaaggaattccatgcctcacctaacgttgtggtgtacaatgctgccagcctgactatccctcctgatgaggattctatcttgtccatcccattcgacactgttgcatcggatctcaatctcaacaccatcagcccttatgttgcagcccaacaagcaattcaccattggcaggagcttccgtctgacatcaagaagaccttcatatacactggtaatatattgaacgtctcggttatcccagctccaagagtgctggatctgggcatgggcaaggcggcttcagcattttgggttggggtggcagacgcatcgtacgcggtaaagggattccgataagcatatctacgcattacggcaggttcagagcgggtttagattgatgtaggctgaccgtcgataattaggttcttttacacggacgaacgaaaaagtgatggtcagcctgtctcgacggaaaacgatggcgatgcacatggtgaattctaccttgagttatttacccataagggacagattccatggcacgccacctttgttaaggaccaggggtatgttcagttcaagtagaccagttatgtggtctcagcaaaatgagccatagttaaatcaattgcaatactttgtgaaacaatatcgggccaagctaagatccaggttggtatagtgtccgtcacgccagtgataccttaacccaggtgtttaattatatatattctctaaattcccttaatcagactacaggagaaagaaacagccttgggccagtcaaatcgtgattcatcaaacagtaaatggtctgcgcaaagacctgtcgaaatttgcttggctgaaattgcttgatgcgcctcagtcatattgttggcttgtgcataagggggtttttagtagtcattcgacgtcctgacggcaagcgagtcatcggcatgaaggtttatagaattttctgccgtatgactgtagccttgggctagcgaagctttttttttattaacctttcgtattcattgtattgagttgttgggtctgacttcttcttttgttttaactttctatcaaaactctctccggtgcataaagggttagaatgttcaatgggggattggtaatacctaaatgaatgacatacaagctaaaaaagttgtaaagacacctacggaccaaatcaatcgttattgttggtactctcagaactactttcctcacttgtggttgctttcttgttgacttcacctaaagcgttctctaaactcaaagccttctctaacttattgatggctaatttataccagctatgcacggtcgtacctaaactccaaagatttctttttcttccaaagtgactttctttgtcaaagctcttgatataaaggctagtagaatgcagcaagctcctgacagtcggctagactaacgtccttaggcatgaactccagaagcacttcaaaatgtttgttccatttgccaaattctcatcataaccaactaaccaaccaaggacctgcgtcatgatcttcaatctaccattgcaccccagtcttgcgcagggaagcgcaatgcgtcaacaatcaccaccgccgttactccgcttgccccctaagatccgcgagagaatttatttctttgctggtctcatccgggaatgtcccgttgctattgttccgtttggtaaacccaccgcttgtttcatgccttcgagacgacggccagctatcgacatgtgcgccttcgaacttcgcaaaagtacaaggtcccctgtccgagtggccacctctgctgaatgtttgtgcccgaagttccctaaacagcttcttctcgtttgcaagcaactgcatagggaagttgaggagatcctatatggcgaaaacaaatttgttatcccagcccaggacgaagctgagaatctcaaggttctaaacactatttctaccaacgccgtacggtctttgcgccacctcttagtccgcctaaatagctggccatgcattcgagggcacagttcgccgttcagcaatcccaaagcatgcttgatttgtggatcatccgcaaacagggctgacctagagataccaactcacaagcgttctcaacaaatcatcgaaacgtgggagaacgtgtgtggacgcttagcgaactcagacatcgcctcagggcagctccatctagaattcgtctgtgatgttgaagacttgcagaccgctcagcgtgtattgaagccgctcgagcttctcccgtgcttgaaacagtgcggcatacgtctggggaggagaccagagcgggagctccgctcacttgctcgaataactagcgagaagcttactcggaaaaatcagaataccgaaggcttccttttctttgatctaccgcgggagatacgtctccagattcttcgccacacaaatacgggccctagtagcgactctctcacagatgagcgcacgatccgagttctcaatgggaagttcgaccatcgataccccttgaccgacttacaacccctagccaaagctgcagtaaggccctgctgtctcgactgctcttttacaaaactacattgcctctgcccatcgaagaatgcgtcttataatcctagttgtcggtgccgggtgctgcccctagcattatttcttaccagccggcagatgtattcggatgcctctgagatattctactcggaaaatatgtttcattttcaaggcccatttacaaagaccttgtcggtgcttgacagtataccagttcaattgctgaagcgactgaggcgcatcacctttgacctagacagccaaaagatctttctatggaagcatttcaattaccattctcaatggcgaaagctcatccgcttccttggcaaatattgcaacccctccaacttgctgatatcaataactgcgacagattatcgagcgactaccatgaggttcggaagcgaagaggacagggaagacatcatgcgacacatctatagcgtttacgtcgatgtcgtgcgtgccgtcaagaaatggctccccgggctccgagatttccacctgtctttcagtattttcctgaagctggaagccgtcttggagaaattcgtcatgggaccaaattacgatagttcgcatggcaatcgttatcccaaggccaggaacacaaaatggcaacttccaaatgcgcccgagtacctcacagagatccctgcctggcacacagacgtgcaagagttgtagatattccgaaactcagaaagaaaaaagaggcgaaaaaaggaaccggctgaaccggttggcggactctcccgccgggaattgaacccgggtctcaagcgtgacaagcttgcatactgaccactatactacggaagatgatcagctgttttcagctgctgtagtggattggtgggagggagatgcacatttgacataagagtctagaccaacaccgacgaggtagacaaattcagatctggcatacaacaatttaaaaagttgaggtggctatcattaatgtgactcgtggcaattaagattaggcgttagactagacgttataaaacgttacaactatacgaaaaaatgagacattatatcagacatcataacagtgcaactgtgggcatgagaatcatcttgtgactggtgtcaattagcattagacgttacaactaatatatatgcatgaatctattctcaaagcagatgattacatcaaatcacacataaacaccagtgcctctgtatctgacactgaatctcaatcccatttcactaagccaggcaacctagaccgcagaccaggtaagctgcagcgtcagagccttctccaccgtgtacaccttagtattcccgctgcctgttggcagctccgtggcgtggaaggtgttagcccccaggtacgtcacgtacgcgccgtcccagccgaagctgctgccgagggtgacgctagagtcgcagaagatggacatgtcggcaacgatggcgcacttgcccttggacgactgaagggtgaaggtgacgccgtcgacgttaggggtcgctgtgaagatggccgcggtgccgccggcgcggtaccagttgccagaggtgaggagcctcccgccggtcgattcaccaggcgtggatgctaggacgttgccccttccggagagggccttgcccgaggcgatgggagtagctgtggctgagacggaggaggatgacggggttgtggtccttgttcctgataccgctgtggtggctgtgatgctgatgcccgatgacacatgcgtgggtgtgccggtgggagtggcagcgggagtagacgaggctgagatggtgacgtcggacgacgcaacattcttaccgcagacattgatcttggccaccgtgggatcgtggtcagacacttgatcggcgtacgacacccaggtgttgacgtggatatgttcctcgaggggctggaggttggcaatggcagggctgacgaaaaggtgatcgagctcctccatgtccgcaccgaaggtgtaagtgtatcgctcattgacgggaatgccggctgccacgtcgaggtcgaccatggacgacacggaagtgaaggtcttgacgggttgaaccaccgagtactcattcaggtcaccagccatgatgacacgcgcatcgctgtcgatggccaagatatcagcgatgaagctacccgtgatgttggcctgctgggtgcgcttctcgacaggcgagttgacaggagggcggagatcgccttgaagactggagctgccgcccttggactcccagtgcacattgacggtgaagaagacgtggttcccaacgacggtctgccactcagcgaccagaggtttgcggctcgatacccatgcagcattggctgggtcgatgcggcctgggttatacttgagcgtcgggctaccgttggcacccttcacgactgcgctcgcatcagtggcactgccggcattctcattgtgcagacgaacaatatcggggttataaagataagcctggcgaatgttgcctccgggctggccaccatcagcattgttgaccgggttgatccaggtgtaggagtagttgacgccgccaagcttggtgatagccccagtgagggtactcaaggtcaaggaggagtcgacttcgccgttattggtggcaccgttgttgtcctgaacttcctggatgaacaggacgtcaggggacttcatgtaattgacaatgtgggcggcaacatcattgacatgggccgtgtccgagggagcaaagttctcaatgttgtagtcacccacagtcaatccggaacattcgccggtgctgatgagcgatgtcgggggaggcagagcgggagagagcgaggatatagtcttaattgcggtcaaaggcaagatatagtagaagccgaactgatagtgaacgacaccggtgatatcgtcgaacttgtctccaatgcgggaggtggtcactgccttggagccatcgagaggagaaccaattatgatagcctcggggttggcgtccttgtcaccaagagtcagacctccacgctcattttggccggtagttggccagttgccgatcatccacgtctcgccatatgtgttgggtttggagacagcgattgggttttggatagtaaccagctctccgttcaagctcttccagaagtccaggccgtacttgtcggtctgcagctccgggttgacgatagacacctggctgacgttgttgggaacaccaaagatatcgccgttgtcgaggaccgagtactgctctgtgggagggttgcgcgtgtccttaccaataacacggggcttgggggtggtggtgcccttgacccagccctgcacaatgggcgactccagctcggtcgagtagaggtaggccgtgtttgagcggtattcggtgactttgccgtccaggacgagggtgtcacctaccgagatcgaggcattcttgccaagcgtcgagctgaagacgtagagtccagtgcctatgcgcttgtcgcaggtccgccttggggcacggaggtacagcccggtagaggtcttggctgtcacaattccagtgacattggttaccgactggccgttgaatggcgacaagaagttcctgccgttgatggcgttgatggttgtggcttgcgccgctgccacaaaggcaagcgttgccacgagaatctgcatcttgcgtaggtgaacggagaatgaatggatggacgaaccaatgagggaaaataaagaatgaacgtatatataagcgagcgtgtaggtgaagagagcaatgggaaaagagagagtgaacaagatcaactactcacaccaggctagtcgacaggggccgggtaccggggacgttcctaaatcaggggattccatggcatactcgtccctaatatatactctatcgacatctactctgaagctcttctattgttaccgagatattgggttgatggttgatgagcagttggcagcttcctattcgaggtgtagccttgagcccgtctaaatcccaaaggctccaatcgggacccgtgctgagtccccgtgtcgtcagaagagggcagtctatctaattcccgttgacgccggccggtttgctagcgcctgggccggaaaagcggcagatcggatccaggaaccacgcaaaacagctatcagccagcaaatccaagccttggcgatcaaatactacatgtgagcacgtgcgtgcctctctgttggatcaaggaaccgtcatagacggcagcaattagtgccaggagaaaggaatagtagcccttggcatgcattgaactatgttctcgacttgcccacggttacatgtctaccccgaagctcattatgactttttacccggcccagtgtaggtagctatctctctggagaatcgtagatataccctggacttaagcctctcacatgaaaaaatcgctggtcacggaaatctatgtggttattgtagaatcgctgggagccgtgctgaagctctgacctctgggccaagcagaagaactaaagtaattaaatttccgaagcgggtttcaacgaaccgttagtttagaaagttttttgttttgctgatatccgtgtaggagtcttgaatgttggatccgtatgttggtaagcgaccagccgcaagtcccaatcttggtcacgttggcttaggatggtaaaaatgcagctaagggcctacaacgggttggaagcttgacagaagcacagttgtcctatgttgggtgtcaatattcattgtgttgagatagtagttctgacatcttccattgttgttttctaccgtgggtcgaactctcatccgttgggtaacagggcagctcaactcaagttacgtacgctatgagaatagaggcggctaactttttacaaattaaacacataagcaacgcctctacatttttcaagcatccgtctgcactaagtttatactcagtaaaattggccaactttgtacttcatctacagcaagtctcttcctaaaattgccatctgagtcacgcttgtcaccaaccgcatcgctgacatataaggggaccaacattaaggccaaagctaaattgtaaatgcgacagagatatgtctcatacatgatctatcatgtggctctgaagatggagggaagccaggcaacgtctagggagcacatctccaatatcattagaaggataggacacacagtccccgggaaccaaacagctatggtgatatatttccaacgcctccacgtcgcaagtgacaccaggctgcctctgtaaactcaagcatatgcgtcccaactcgggagataagttcattcatgggcgacaactagctctactctcggaccacccaactcacaacaacgcaatataaccaagaattacatctcagtttccttttgcccctttcttcacactacaggtcagttagtttacactagagccaagtgtaaacgcccttatactactccgtatgaaacgccaagcttttaaattaggtatagggtattggtttcagtgttggacggtgacggtaatggaatctggagttaggcgcatgaattgagtgttgtctcggattgccttctcgaattggcgctcacactggggtattcacaaggttgcctcatttgcatgttccaacagagatttgctataatgctgcgtgtaattaagggcttagatgactgaatcgttcgtttaggaattccgtatattgatctttgcagattgaaccgctcattgagatgttcaatctcgtgtgcgacaaaacattcgagttgccaaacagaccagcacaaggagcttcaccttcgaaaactcttgcacttttgtaagctttgactaaatatataaaaaccgaggctttttgaatactactattaaaatgacaagatggtctaggttaattcttgttgtttatctgttccccttaaccttgcatcccgctcggccacttcttggaaaggggatagtgcccatataatgtctctactaagtctactcaccatcctcgtaccagcgatacatgcaacaaatcaagcaactagatccagccaaagccaaaatatgaagaaagataaaagtcttgatcggtgtcacgatcgacctcaggcgcagcgctcgagaccacctggaaaaaacccctgaagtgatgatcttctcactcccagatatggcagctgcaattgcgcaaaacacagatccattggcgaatgatgtgcagatatgagcacaaagatggcccgcttcggtaatattcaattcaagtacttccttgatggatatccgtttgcacccacagccaatcacccaccaagttgcccctccccctgaaacaccggctctttcaactgctttgcccagactagcgcttcaaatacacatttccatggcaaaataaggtgagcttgcgggaggcattgatttgaatggccaagaactcttgggcaccagactcaccgcataaggaatggtggtttggcgagcatccaacgtaaacgggctggcccccagattacgcagtgacaatccactgctgacagtcggttctgcttacatcgaggaacgtgttcaccatcgtcgcaaaaggagttgagatgtggcaaattggccacctttctgcccaaagaggaagacgataatgcgacgctggaggctcgatttggcgatctgcgcctctcctctgcccgcaataggcatcccaaggctcgagcacgattatatttagacaggagcacagcaggagttctaatatagcaatgctattgatgactaactggctgacggtgccatttgggggggagtgaccccagacgattccctgtcgcctaatttcctttcatgtagtgcccgctcctaaatttcaggtgccgccactgatcacaatttaacactctgcaccgaccgtttcctactctctttcttcctctctcggttgcgggaaatccaaggctgcacgtgtcgtgtcgtgtcgcgacatgcgagctccgtccgaacaattgctgccctccgcccggacaaacctcagcctcctccgcggtcggtcccattgcgcactgtgagcaagccaccactggaatgcggcatgtcggatcccgcgtcgtctgcaacggccccaaagggggcagatgtcgaggttgagacgtcgcccgagtttctcctgggctacccacagcgggtcgtccttggcgtcgtccaggacgatgactatcctcctagcctggacaaactcgtcgaaattgcccagatgacccttcggtatgtgtgtgtctgcttacttcctctcaccggctctcttctctcgccctcacatctcactgccgggcccgtctcagatactgaccggacacgatccctgccagcaccgcacagcgacatgtcatctaccagattctgaaacgctgtctgtccagcaccgacggcaagtggcgccagatattcaaggccctgcaagtcgtcgactactgtctgcatgtcggctgtgacgagttcctcccctgggctagtttcaacaagtcgctgttctcggatcttcaaacagacgagaggcagcagtaccatgacaccctgcacggcatcaggctcattgagaaggaatctaatcacatcctcgatatcctaagtcgccaggatgagctgctcccgtttgagaagcggaaccccagctcctggatgttccgcgtcacactgtcgcccaacccttttctggaaaccacgcccttgacgaccgagtcgttcgtcaagtactcatctttggagaatgccccaagcctcaccatgcccaaggacctgggggagctcaacaccaatcactcagctccaactacagaatttgagatcaatccaacccctatagagcccattaatcactctcgggacctatctgagatgttgagaagccgccatgtaaggaacgggtcatccatcgcagaatcaattcgtcccagtacctcagcggatgaccgcaacggattccagtccaagattctccgtcgccccagtacggcagttgatgactcctccaatagcgggctacaggcgaaactcccctggcctctggggcctctggtacatgatgggcgagaacgaggggaatctctcacacaggaaccgcctgtgcccaccctcgaccctctaccccgtgaccttggccttggaatctccctctcgagtctctcactgggggaaagggagccctggccggcagatgatgccgtttctgcaatctctgtcaactccctcatctctccgagacagccgccatcagatgcatcgtcaatcacaccgcccgtcagtggatctgggctcccttctccggcgcaaagacgccagtccaagaggcatcgccattcaatgaggtcgcagagtctgatggagttgaggaacaacccccttaggcagaatgatgaaccggtcgtagttgatcaagcgcggtacatcaacatcggacccttgagaaaaggatcgattgcacgaaccaggccgacgcggtccagctcgtctctagtccagcaggcacactctcaacaaggatatacacccacgcctataaatcacatatcaaattatatgatagcgtcaaaggtggacagtgtatcatccgtgagcgacaggagtgaatctgtaaccacctcgagagagtataaatactccagcccggctcgttacatgcccactcgacgaatagtgtcagatcttgtgagcgattccaaattagagacggtgttctcagacgacggaacggtatcccatacatcctacgagtctagtatcgctactcgccagcgccgggtgaagcgggaacacaggtggaaacgatgctgggagctaagcaccggcacgtacgggcgtgtgtggctcgaagaatccatcaacgaagaggaacggggaaatcttcgagccgtgagggagatttcgaaaaccaacaggggtcagcaagtcaattacgatcgagaactggaggcaatggccaagttctctcattcaaaagtgggtttcatcatccacttgaccagtttggcactgcaactgactgaccttgatagtatgtgcattgttttgttcaatcattaggctggtatgaaaacacgactacgttatttacagcgatggagtatttggaaaatggagatttagggaaatttcttacacgggcctttccggagacagaggtcaagcttattacgactcagctgctggagggcttatcatatatgcacgaaaacgggtttatccatggagatctcaaacctggtgttagtagtcctactatgatcccacttgtctttcgaaaagctaacaatcgacagaatatcttagtatcagaacaaggaccatgctggtgggtcaaattaagcgattttggaatatcgcggaagtccgaggaaatatcaaccaacttccgtaccatcgtcggaaccaggagttacctggctccggaaatacttggcatattcagccctgatgataacgattcagacggcaaagatgacgaagatgacgaccgaagcgaaaaggaggagacttacaccgccgccgtcgacctgtgggcgctgggtgccatcatctaccagctgctcaccaaccagggagctttcagcaagcctcggagactgtggaactatgtgctccggaaagcgccgtttccaagtcgactgctgagcgaggctgggataagcaaggaatgctcgaactttttggaacaattaatggcccctgctccggggaatcggccatctgcaagccaggctacactgcacgcctggttgttgaaggtggacgagtaacgggggcgagtttgtatcatatgtatcatgaaatgatttaaatattagcgtccaagggacacgtctaggcatggttttagggggaaacgataatagagaatagatgatgactccgttttgcggcccaaacctaataccaggttgagacgctcttacaatcctagaaatgacaatgggcaaataacgccataacccctttatggcctatcattcattcatatactctgaccgcgtgataaaagcggttttgacttttgatcggaccatggccttccgagctaaaatagacttggcattaacggtaataacccgagatttgcagatcgttgtgatgacaactaccagcatgagaactcaaactcctgaccaaaccatcgatgaaggttccagtttcatcgatggtctccttaaatattcttagagggttgagtcttatttgccatacctcttgaagttacgtcgctcaatcaccgaaagaacggcgacgtgaactgtcagaacactatggagggttagatggggttttatcaggatatgctcaggagaaagtccatcttatgcacttacaaaacggccattatcactaaagtcaagatcacgttgacaccgcagctgcccccggagcattttctggatattcccatgaatttcagaatgatcaaggtgagccaaaacaccgtctcaaggcagttcagaatcgcgttcgctttggtgcttgcccatttactgaaccgttgcgtatgctcagttagcaactgataggcgatgatgacgatggatttaaccgactaaaagactcctgtcagcgtctagtccaggttcaggtatcttgggggtttccaaaaccgggcaggcgacatacaaagggtatagccatgatctccgaccgcactggaatgactccaggcatgcttaaatagactccgcagagaataattacgagagtgacgagtatcagttgaataatatggtcgcggaacttccatttcgggtctaagattccagacttcatcgtgagcggtgttgaagggtgtctttcggggggaaactaaatcgatccgcaagaatccagattaggtagaaaaagagctggctatgagaaatgaaaaaacaaataaatgtttacttttatatctatgcagggcaagaaaaagcggatgggatcgaaggaaacacgagataagccgagtttacgagcttacacccgagcttcgggcgctaagccacgcaactcgagacgttcctgtggggaagcagtatctcagatgtgtatcactggtttctagggcctttgacaggcttggcactatatttcggcttggctcattcgccatggcgagatcggtagtggtgttgagatgacgttgcattcggcgctttctgaatctctgcttcccaacaggttgacagtgcaagatatcaaaagaaaagagcaagtactcttccatcactttcatgaagcagttcacacgcttgaataaactatctatgctgagccgcctgtccctgatgcgggccacgggccgccctgagccgggtctgtcgccacgttcaactccatccctgaggctgaattgagccagctattccagtcaacattgctatcaacatccatatccatatctaatccagtaaaattctcggtcaacggatccgtggtctcgttccacagccagggagtgaaccccggacccatgagctccggaacagtgccagccggcacaccgtatgatgacgcagctgcaccgtcagccaccatcatcccttggttggccgatccgtgtacgctacccggagaggcggagctagggagaaacggtatctggggaaatccagccggggccagatcatacgactcagagaccggttcgccaaccgacatgctgctgtcctgcacagtaatagacggggcaggctgacgaccctcccctcctcctgtacccgacatcccaaaaagcccccgccaatgctgcctgaacatctcctcgctctgatcaggagcaaacggcccatggctcgccggcgccggaatccgcgcatcgctcatctccgccctcccaatcgctcccgggtcgctccgcatcctcgccagctccgcctcgcggtgcttccgcgccttgctcatcagcttccgcagggggacccaaatcctcagccccttgtccgcgccgggccgcttgtcggggatcagccagacgctgtgcagggcgagccacgcgcgctcgacgaggggcgacagcggccggcgggtgacctcgaggaggaggtagacgatggcgtgccagtgcgtgtacgtctggtagatccagcgccactggcgggcgtcctgttcggcgttgagagcgtggttccactcggccacctcgagggcggcgacgaggagcttgtcgcgcacctcgtcggagaagttgtcgctgggggaggagaagagcgcggggaggtagaggagcagggtgagcttggagatgacgaggcgggtggccgtgacgccgacccagtaggctatgtttccggtcggggatatgtagcggatgtgacggttttggaggtggtcgtagaggttgttcaggatgcttgtctgttcttcgagggttttgttggcgccaggggccatcatgttgcgtgtggcttcgcagagttcgtatgtagcgacggagaaggtcatgtcggtatgtccttggcgctccacgggaggatcggttatgtcgattccaatgtcggcgtcgttgatgtttagtgggagcttagtgtcaaaactgccgctggtgatggtgaactctgtgccttggtcctcggacgagcgcatgtcgagaatgcagagcccccaccaggttctgcgtcgaatctcaatctcatagggggtgaggtagtcaaagtgggcgccgtcacggtgcaggccgatcgcatgggccattcgaatgacgaggccggtcatcatccagacgaatcggggactgtcatggcggcggacgaggaacaggaagatggtgaaagcttggacgagaacaacatccggggagtttaggaagtcggctctggcgagggcgtgttccaaaccaagacgatatttgatattgagctcagacttggtggagccgaagtttgtgaggacctacggtagtgtaagaaagaaggaagcggttaggcttgtggtgacaggcgggtatgatgattttggtacttacatcatcttcctccatggaagtgatggctgcgtagtatattgaaaaaagcaaggcctcgtaggatgggcctaggttcgacatatccttgcctcgcagatcgcggatcatcttgttaatggtggggatgtgtacggtctgaacaaacaagttcacattctcggagaagacgctgatgaggaagggtatctgggacggaagagggcgatagctccgaaggctagatgaagatttgctcaggttatggccgaacatgaacccgtgacgctcggaaggcgttcggtccagctcgaccgtggacggcgtcttgcccaaggagtcctcatcttcagatgagtcggtatccccacccccaagtccctcagcatccatcttgaggccgtccagctggaagagaggttagccttgagtctaccacttgatattcaccagaacatagagagagcattacctcatcgctgacccgggaccagaatccgctgctgatataccttgacttacttgtgtcctgcaagaccatgcgcccaaagtgcttctgcatgctggtcgagctgataggcggcgacgcgccctctccatgctctccatgacctgaactctctggtgagccaactcccgacgagccccccggcaccgcaccaggggggcttccactcgacgaatgggcctgctcaagctggccgctcaactctttgaccagtccctccagactcctcagcctctccatgacctgcccaaccccagcctggtcgcccccgtgcggctgcaggtgctgtgacggcgacgacgacgcatttgccgcagcagcagcagcagcagcggggttgttggtgatgcgctccagccgacgagcccatttgggcggccggtcgttggagggcacgacgcaggggatattggccctccggcagttggagcacggcgactgcttgtcgcaccggaccttgcggctccggcagacgacgcagctgcgcggtttggtcggcggcgctgaggcgggcgagacggacgagctcgcgcttttctcgggcgcgggcggcgccgacctggtcccgggcgaagtaccgcctggcagctgcgacattgctgcccttgcgtgtgtctcttggcgaggctgatgaggacggctccgtctctgctggggcacagccgctgtgattgttgttgatgcagcttggtggttttcagcggctgcgtcggtcgcaggatcttgggctgtgatgctgactgacgcctgggaaatgagtcttctacctccatatctggctagcacatgttaacgccagacacacggggttttgatttagccgtgtcatagtgctgaatgtacattcgaaagccatatcaagtggtgattggtgggtaggatacaatgtctcccatataagattcatatctgtcagacagtagcccagcatctctgccgtgaacagggtcatccacatattagttcttcgtatttctgatagcaaatgttagtggatgccatcagaggatccgtcaccactttggttttggcgagcggcggggttaagccagtttcatcggcatcacccgagatgacaagggtccggtcaccagatgcttgttccagacgtgttgaaatacagtatgtttgtatagggataactttgtgtattaagagaagaggtgtcaaaataaagcaactattccagtggtatcaagtgatcctatctatacaataagttcgccatgccaagctcaaaacaacagaagaaagtaacgccagatgaaggaagcaagggtccagtacccgatcagtacgtgatggtcgcaatcttattcacgtacttggcctcgcgattcacaatcagattatccgcaaaccacttgcctgcatcttcgcgggaaatggtgtatccaatcgcatcagactcgcggcccgtcttggggtcctcgatgcccacccgaatcggcgtgtttgtctcgccattgaccagcaggctgcaccgcacaacgcaaaagtcctcgccgctctcggccagcgacgtctccatgatcgccttgtcctcgtggggcaccttgagcaggatgttgtagagagggacgacgagcagaggagtgtcgcggccgaacttggacatgcccgtagtgctgcagacgacgatcaacggtctgcctgcagcgccgtcacggcgcagctgctccaacgcctccagtaaggtggccatgcctttgcgacagacattgggatcgtcaatgctgagcttgagcaggtcgggccgggcgccgatggtggagatgatctcgtcgacaagggtgccgtcttccttgcggaggacggagacaaggactttgatgtcgtgcgcgttgccctcgaccacgcgcagattaggggtcgtcgacagcgggatgatgtcagtcaacttagatggtgttcggcagacggcgatgcactggtggcctgcagccagggtgtgcttgagtgccgagaggccaactccaccgctggcgccgaggaatacaactgtcttgggggaggacatggctagttgggactttgggatgtttgtttgatggaagtatgtgagttaggctctgttgagtcttgaaggtgttgatgttgatgttgatgttgatgacgttgatgtttgatggtgttcatttcatcatcaaaccgtcaaccagacacttctatatatgcacgatccagcacggcttccattcgccagtctgctcggccgagctgcaaacatggcgccttgcttcgcccattgcctccactcttcatcaccatgtttccgttttgtgcgacgcgagaaattgccgaacttgcgcgaggcgcgttgtgagtcgtcacgtgatgtcttcggctgcctctcgctctctcggctgaacttcggaaaatctccccaccagtatagctaaaattcagaggcacctcaatgtaaacagcctaccctagatcgaggaccaagatcacgatgcatcctctctcaacgtcccgacaaaagtcccccagtcaatggagaaagtatttgcgactattgaacttgccaaaatcacgtcatctctatctaagggtatatggtgtgtccacagcatgttttctttagtgactgtccgtattctagtacgtgctgcttaacagatgtgaaaacgtccacattttgggaagtctctccgttgtgatacgcaaaacgcagtacgcaattgatttatcaaccagcctctactcgcatcatatgcaaccttgactccttgacttaactgaacgattcgatgtggcggcttcacttgaaacacaacaagcaaaagctcactcaccccgcatctgggggtgagggatatttcagggacctttgtagtctgtcaatcagtctcaaactctctagaactgcaattcatcgatgatcacttgaagctcactggaaactatccaaggtgaacgtcgtattcagggtcctgacggtaagtctgaagggttagttctcggttatttgtggtattgcaaggatgctcaacccctggccttcacccgttggtaaacgacaaacaaaccccaggccaagccgcgttagcgtctgggtgaggcaaacgccaatcggtcttggcttgtcaaaagatcctctaggagtagagcctccgtatcagcaggccgaattctttaccaacgatttgggcttatctgacaagggaactcatcatttgacaagggtttactaactttctgataggcttatttttcaatcaattcggattggtctcaagtcggtgaccctgctggatagggtaacaaggtccgttgtggaggaatggttttgagaagtcaattaaggcgtcatctgaaaagagagctcgaaagaggccgggggaaattgcccaccttataaagcatgggccaccagattgagcagaacccagggtagaagcatgagaccaaagccttggaaagcccgccacgaggtacatcgaatcatccgctcaccgttatcagcatgaaaccatattcggccacgctttgctcaactgacacaacttcaaaaggaaaaatggtggggttgctacggagatttcccggggggcagaaccaagacaagctctagactgcatccttgctgttacgtgaatgtaacctcagcatgttgatagcgggcgcaatccaatcgatggaagctaggccgaaaaactatgccctttcggtgcaaggatatccaacgttgaggcgaactttttgcagcccacccatgtcgaacttttgtgaaggacttttgggatccattctggaaggtctgacgatttagggttaaatattaacttaaatgattattgttcgcctttatctattcactctgataggctccttctgttctgggtagaagatggggaagaatgtaaccgaagctgcgtgagattatgcgcttcggtacgaccctgacgaggtccagacccttggtcgcctcaaccaaacgagctttcaacgtagcatcgaaaccgcctagatagcagataccttgatatgggccgacagagagccctactgggattgcttggcgcgtcccctcatccagctggcaagaggcctccctggatacataaggtggcagacggttacattttcctgcttgaacctctcgttgactaggactgttctgtgccgaacaaatcttctttcgatcgcgtccaatggctaccaaggctagtttggagatcacaaaggggggctcactcgttgagcctaccatggtgaacgagagcaactctccagactctgaccccgaggagtccaccgatctccttcacccattcccaaccgaggaggagtggcagacccttcctcgcgttgcgggcagcatcccatggaccgcatggaccgtcgcctttgttgagtttgtcgaacgcttctcgtactatggcaccagcgctgtctgtgagtttcacccgtccagcaatttgcccccatagagcgtcccagagctaacccctcccttagttgtcaacttcatccagaagcccctccctcctggctccaacaccggctccggcttcctcaagacaagctctggtgccctcggaatgggccagagagcgtccacgggcctcactaccttcaaccaggtgggttaaccgtttcttagtgggatgaaagatgtccaattttaacatgactctctctagttttggtcgtactttactccattgattggcgcatacctcgcagacacgtattggggccgctacttgacgattcaatattctaactgggtcgcgctattcggtcacgtcgttctcatcatctcggccatcccgcccgtcatcgtccaccccaaggccgccattggcatattctcggttggtcttgtcatcatgggctgcggcactggcggcttcaagtcaaacatctcgcccctcattgccgagcaatacaaagattccaaggcctacgtgcgagtaaacaagcgcggccacaaggagattgtcgaccctgcagtgacgacggccagaatctacatctacttctacctcctcatcaacatgggctcgctgaccggttccctggccatggtctactcggagcactttgtcggcttctggctgtcctacaccctgccgactatctgctacctactgtgcccaatcatcctctggtacttcaaaaagtcatacaagctctctccaccaacgggttcggtgatgggcaagggttataagctgatcagatacgcctccaagaggagcaacggctggcgcgaccccgaattctggaaccgcgccaagcccagcgagatccgagcccgcggcgagacaccgcccgcgtggatgacctttgacgatgcctgggtcgacgaggtgaagcgtggtgtcttggcctgcaaggtcttcctgtggtaccctctgtactggctcgcctacaaccaaatgaccaacaatctcgtctcccaggctagcaccatggttctcgggtcgactcccaacgacatcgtctccaagctcaaccccatcttcatcgtcatcgtcatccccctcatggactttatcatctacccggccctcaccaggatgggcgtcgttctcagccctatcaagaagatcactgctggcttcgtcctcagttcattcgccatgatctcggcctgcgtcacccagtactacatctacaagctgtccgcgtgcgggaacgacatcaacgcccaggtcaaagctggccgaaaggactgcaccgcccccatcaccgtctggatccaggttttcccctacggcttggtgggcatgtctgaagtgctggcatccatcactaaactcgagtaagttcatattttcaccttgaattcattacctgattgatttgctaatggtttcgtagatacgcctacaccaaagcgcccaagaacatgaagtctaccgtccaggccatcgccctcttcacttccgccgtttcctccgcgctcggacaggctctcgtcggtctgtcggaggatcccctgctggtgtggaactacggaactgttgctatcatcgccatgattggtggtatcggattctacctgaccttccgtaaggctgatagagacgaggatgccctgaacaaccaggtagagagtaacttcattggaaccaatgacggcgccccagaagagaaggtggtggatctgaaggttgatgagaagcaggagattaaggaaaccaaggagaccaaggagactgctgtcgtgtagatcgagcgtgcattaaccttgacgcgaatgggatataccaggtattgcgatttggaggccggaaatgcgaataaatgcttagtactataagtgcgcttccagtagttacaaccttttaatccaaaatgccatcttatcaatatggctcgacatttttctcgcgattgaatgccgtgctcgtcaggatatcataaaaacaaatcgcaaaacttcatgttaattggtgctctgtcgactcccaggcgctggcgagctggaagcgaatctcgaaacctgccgcaagtgctccggcgtgcccaatgctaccatctccttgccgtacttcttgtgggccaccttcttgtcgcagttggtgcaggtatgtgtaacatggcacctccagttcttcttgtacggaacagctacacctccgatagtggtgaggaagagacccgtagcagcataactaatggaatgtgagttggggagatctcgaaggggtcaatgtcaatctgcgtactgtgtttgccttgaagcctcgtacttcacacgagtctctactcgttgacggcagaaggggcagtcaacccagtcggcctgatcgtccaggaggtgtagaggcgtgacggtcaagtgatccccctgatccatcattgacggcgcctcgtttcttttggaggtggaattgatggagactgcggagtgattgccgtgtaccattggcgccgaataggaacgacgtgtactcctattgtccgacgaggagacgacgacctcagggaagcctccgtcgttcacaggcgccaggcgtttgcttcgttcgttagatccacatcagccctatcgatgtgagggtttccttactctatggaggattgggtctggtcgacgaacgagccctcaacatcaattgcctgcttcgacctgtccacttgtgcgtacgagggcgggggagttgcacaatcgggagcgatctgggacgacatatcgaacagcaattcctccagttaaacaacgacagtagcaatcttgcagctcctgcgtcgttcgctgggcggtagctactttaatgttggggacggaggaggagaagaaaaaaagaggccgcccccgttcatctattgctgggcttcagggattatgctgacggccagcccagcttgacgtagcggctgacaagtgctaactgtaaaggggcaagatggaacggttccatgcaattcagaatctcaggcgatcccagtccttgccatcactcagccctgctgcttctaatttcgtctttgcccctggctttgccttggatagattcgtccactgggagggctgactccggagatcttgatcgctatttctattgagtatatcaatctgttgaagccaagttctggaggacaaagaggtcttgcatgaggctaatatcgcatattgcatggtctcgtccatagcgcgtatgatcctcataataataggagatatccccaccacctccactcatcctgtgtgttcaaagacggcacgtcgctgccgggggctgattggattggagtctggtctcgcaattttcctaccaatttaatatgagaaaccgaaagcgagcacgcaagacctagtgacgaattgacagactgcgcctcaaacaaggctttctgttatttatcattcacgactaatatcagagtccatatctattgagcggcacccgtttggcttccaatgaccttcggtgaaggcttcaaagcaagactgggttgtaaaaagtcaattactgtctggtctgtttacccgcctctgcctagactttgttgatccctgaccacattacttcccaatatgcattgactataattagtctgattcgtgaaatgaatcgacgccccatcggggatgataaaaacaacaaaagcaaatagaagaaatcctcaactccatccgaaccaatcatccatttttgtgcctgaactccttcatttcctaccaaaacggtccgtccacaaactcctccgattgtcaaaatgattattagactcgcgcattgactttgaaatgaatctctcatatttgaaataccccaagtctccatcttacatctttcttttttggggttgagacatcggaagggagatcgcaaacagtcgtgaatacttctcctagggactattcgcgagccctaacactgaccttgttgatcctgctcacgtgcagagagtaagcctgaactcgcgacatatacctgacggatcccttcagactgtgagtgtttcgacagtgcatcagaaccctcctgctgtcgtggtcaacatagttgcagtgatcgcgtgggcacacgtaagcctcgctggcctcgagaaatggaaccggcctgatttcggttggttcgctcttgagcttgtccctgattcgatccatcatggccgcaacgctgtagtcttccggtagattgtccggaaagagccccaagcatgctgtaaggatgtggcggacgtgtggaagggcatggcaattgaggagatgctgctcgatatggcgatgcgtgttggggcacgcaacgtggcagacggtgcacaagacgacatccaactccgggataaggtgaaagtattcctgagggggaccaagatgcaggcctgggaatgctgtattcaggttgtcggcccaggagccttcctgggaaccttgctgctcatgtccatgtggctcagcttggttcatgttcgtggcatctggggaaggagcttgtgaagggctccggttgtagagacgagagagctcgaattccgcagagcctagtggaagatctcgtgaagtctggttgtagagatgggaatgctcgaactctccggagttgagcagaaccggcggcatttgtaggtttccattacccgatttgtcttctgaatcaacagccatcacatcctgggcgaacattggtaggctgtcgtgaactacctgtgaaccaggtgaagccaaggtcggcccaagacaggtgatagtcttgtcgctttcatcgtcattataattccaccagttcataaagtcatcctctgctgaaaccttcgacatggatccatcctgctcgtttattggattcttcttctcaggttgatccccgttgtggtcggttgctgggtctttcttctcggatggtccatagaaatcctcaacaatgtcatgaacgtcttggaaggaaaactcagggtcccacccccacatctcaaagtctcgtcgagaggagttgatggtatcgtgaaccatagtgcctaggccgaaatatccgtgcccggcattcgctgtagctgggtgagagggttcagcccgttgcatcgacgcgtcgcctgatatgtggccaacaagttgtttatccatcctgatgacacagaagcaacagcctttgtggagcgtgtggggggtggatcggaaggatgccagtgagataaaatcaacaagatgaagcgtttggaaaactactctgatcaaaggttcagttgactgagtacgttctgatgagcgttgtggtagagaaaggtagaaaggtgttgagaagttgtgaggagaaagaagggagaacttggttggagttggagggaagcacgcgagttcgtgggcgaaaagaaggtacggtgcgcagtagacgtgtctacgtgcaatataccttttcgtttggggtgcgagtctttggcaggttactagttaaggtcactacaggtaacctgggtttggtcacttgtttgtctcaacgccatatttcaagaagcgtagaatcactgcctgttactattgacggctttttagcagtatttatttctgatgcggcttcattgttaatttttagccttattcccatgcgttggaaatgggagatgctcaatgccgactctttgcttccccaaatactcagtaaccggaacaaaagctattccaaggcacgacaatttaagaagcttcgcacaagctcgcctaaagctagaagttgcaaagatggtcattgagaagtgcctgcttggttacaggaatttaaaactactcattgtgtcactctgctgcctagtttcctccgttctggaaaaaggtgaatttgacctgaagatgatctcggactagtgtgcaccttgtgtaaccacagcttttacagctgtgagatcaatatcatggcgtcatatcgcatatattatggaggttctttcatgtcgtggagtttatacttgcaacaaacgatcggattctaagaactcgttcaccgttgttaggcactgatgatgcggcaacttgttgatatgtgccaaatgataacattggagagttgtcgaattaatgagaaagggtgtttcggacttcaccttgaccgacaagaaatagtcactgcaaaatcagtcaaagtcactacaggatgaataatgctctcatcaaagttacgatcactggaagttcatcatcgagatcggtggtgggaaactgaagtggctctggaatagaggactaagaaaagaaaggaaatcatatcgcaggactatcaagattgctgatcggccgaggatcagagcagagacgatgatcaagaggcttgcggcctataaaagtgttcgaactttttggtagactgggtcggtggcttggtgcttgagggcgaagggcgcatatttgtttgagccaagccataatgatggccaggactgattctagatttgttcgttcgttcgtgttgttgaagttaccgaggggtgtcttcagtgtgttcatataatcaaggtaaggcaatcgctctgttgactagccaaccatttggggactcccgaggccaccctacgcctttgactagtatccactatgaaactcaagacggtttatggcaattagcttgagaataagttgagtgagaaacagatgatgttgccagctgcttctataatagctagaaagaagttagatggatatgagaaagtgtgagtatgaagagggtgggtggtccacgtggattgttatgcatttaaggtatacaggcttcattgctaaaagttctatcactaacatccgctcattattctttttccgcccatgatagaagagataaaagtgagtatcaccgactagagtagctatttcatcaaaatcaattgcaaatgtgcctagaaagccgattgagggcatatcattatggagtcaatggggccttccagtctactgaacgaaacatatcaggcggaaaggcgagtctccgccctcaggtgaaaccaatctaatgggtaattaggtttatatttggcatctcacacttcacatctcgtaatagtggatcaagggcttcaattcgcggcaggggacaaagggggtctgtaagagggccttgaaagctagtcaccagacagatgatgctcagcagaaggagaaactgagaggcgagtcgatatgtagtagtttaccgacatggtacttgtttgtcgaagtggtgtccacgagtccaacatacgtaggatgatggaagtagattacacatatgaccacttcatagtaatactactccgattctcataatgcccatcccaatcatccaagcttgtcgtatcaagagaaacaaatttatattttcgtcggatgaccattgtattattgtaatatgatcgtggaatgagatcagaaactccgttggtagtcatagagttgaccgttataataagcccccaaactcaaactcaacaccagcaaaggaggcggaagaagccatgacttacacactcccaccacatccctcccctcacccctcaaacctcgcccaacttcaacccacgccccccaaacctccccaacctccctcccagcctgccctcctcgcccaccaccccttcctcgcacccacctcacccccgccgccgcacccgaaacgtcagccagtccgccccagcactcctaaacgactgcaccagcgtcgtcccccacatgtcgttctccccgtcgtgcaccctcctcatgtgctctctcagcaccgcccggttccgccgcggctgcccgcacagcaggcagaaatacccgctgaccgcggggcgcagccagggaacctcgggcaggatcatgtccgcccccgccgccagcgtgtacagctcccccctccgccggatcatgttcctgtcgtcctctgtcgtggcgagaagcgcgcgggcctggatggcggccttgtcgagtttcgggccaggggccatggagtagcaggggccctggaggtggatgccgatggcgatggagctcgtggggattaggtccttgcatgatttgcagtagattatctggaagggttcgaatacggcgaagtagggcgtttctttggcgcaggtttggccctgagtaggtggctttttatgttgaagaggcttttggagttgccggtgtacgtgacgggcaggtctgcgagctgggggtcccatctcctcaaaagggtgtcctgtttgtggtgagcagctgggcaagggtaaaggaagaagggcaccagagactaaccaggcattgggaagggcatcctaggtttccaaccaaccacttctaggccctgtattatcgatcgttgctctcaaatcgtgatagaaatgaggatgagagactggatggagtgtggtgcagttaatgaaacgccgagttgtgtgaagctgctgttgttgagggcgacgatgagggcgctgacgagggcaacaagggcaacaagggcagacggggctggttattgtcctcagttcggacaaatacacaatacacacttgcccctgctggcctttcccgccgccgccttgtgtgcccttctgctgtttctcctgcttcgcctcctgctgcgtctccgtcaacacacgagtggctgtatcgtaagccggcacgtaaactggctacctctgctgaactcgccgtgcgcaccccctttgccacatcctcagaccacaaatataaaataccagcagcatcagggttgccgtatgaacgtgttgtcgcgttagtaacaacaaattatcacatggatgggtttctggaacttgttagggtcggagatttaccctccttgacctctgttaccaaaggaagccccagagttgcactggtgcactcgagccagaacacattcctatggacacaagacctacagtaaccactgactcactattgggagtagaagcactcaaaattggtttatttttattttctctaacgtgaatgatccatatctgaatctaatgtgcttttacttcacaggatactcaagccaggtagccgttctgcttcagccagttctcaacgtccgcggaatcacgctctagccatccctgcttgaccttgatggcatccagtgcctgagccaaatccatatcgatacccttcgtagtatgcttttcgaagaacgcttcgacatccttcctttgctcctccttggtgaacgacgttgtaccgatgtgaagaatcgttccaatcatgccgattgaggtggggaacaactctcgcagctgctcccagtgttccttgacccaggcccatagagtgttgatctgtgcgggcttgcggcgaagtcctcccaaaatgaggtacatatcctggttcttgacctccttgctgagggcgtagtcaagtgttctttgaacgagcgcggggtcgtcggcggcgcccaagctgctaagtgcggcgatgcgctcgctgcctgtcttggctgtctggtactccttgagcacggcttcgtactcctcaacaccacccagccggatagcggtagcaaagacgatccggcggaggttagggttgatggcctcgcgatcgccgcccttgaacttggagaacatctcctgggccgcggcggtggctttcttgtcgtctgagccacatgctgccccgaacatgagcgtcttgaattgctgctcaatgtgtccttcttttccggtaaaggtccagccgagctcgttggctcgtttgctaacaagggctcgtaggaaagacttgatagcattgtaaatggcatcgccctcaaatagccaagccgtctgtagagtaccgatgcgaccgatgatttcgccccagacttggaactcgggctccgagtcaagcgactgcagaaggttgagaaggccggatgtcttttgatatccagcctgggtgagcgcgccggcatcggcaaccatgcctgagcgatcagacacgggtaggagaccgtttttggcggcctggccgagcttcttcagtcgctcaggtgtgtaaagtgtgcggtaaatgcccgagtgctccgagttgagcttaaagaaatcgagatcgtcgagcttgaaggaagcctcccgtgtgttgagagccaaatcgtggttcacaccgtctttggtgcgcagacctaggaagacggggtacagcacctcgtcttcctcgggcttaacatctgccgttctgaggaaccgattttgcttgacatggatgctgttagatgcggcgtcctcagtgacagtcaaaacggggaagccaatcttcttggtccagatggtgccgacattctcgacgtccttgccgctggcagcactaagtgcggcccacaagtcgttggtggtggtgtttccgtaggcgtgcttcttgaggtagtttcggattccctccatgaaaacatcctcgccaagccacttggaaatcatgcggatgacagcagatcccttggcgtaagaaatatcatcgaagatctggttgatctcgtcagccaccttgacagggacttcgatgggatgtgagcttcgaagagagtccagggctaaggcagaagcccagctatctgaaacatagccatcccacaccttccactcagggtagaaggcgttgcacgaataccacgacatccaggtagcaaagccctcattgagccacagaccttcccagaaatccattgtgacgaggttaccaaaccactggtgggccagctcgtgttggacggtctcagcaagacgatatcttgtccccgagctgctggttttctcgtcaagcaggacggcaacgactcggtaggtgaccagaccccaattctccatggcacccgcgctgaagtcgggaacagcaaccatgtccaacttgggcaaagggtagggaataccgaattccttctcgtagaactcgagggtcttggcggccagctcggcggcatagacaccatgggagatgtcttggtcgggagtgcagtatgtacgaatgggcagtcggaacttattcgtctcgtagtattcgagatcaccgacgatgaaagcaacgaggtaggtcgacatgatcggggtcttgttgaaggtgacggccttgcgcttggtgccgggggtgatggtggagtcgacctcgacctcgctggccacgtccatgttgcccaagcatgtcttctccttgtcggcaatcaaggtaacggtgaaggtagccttgagggcaggctcgtcgaagcaagggaaggctcttctggcgtcggtggcctcgaattgagtcgacgcaatgaagtgctcctggccgtccttggaccacgacgaacggtagaaaccagccatcttgtcgttgaggttgcctgtgaagcagtgcttgagcaaggccttctggcctgccttgagctgggcgccaccggtgaggtcgatcgtggtggtctgggtttcggcattgtggctgagcgagggcgcggaggacacgggtgttccgtcgacttgaagggtggtctcgtgaatctcgatatcgttgacgttgagggagatggagttcgaatcttgcttgacatcaagctcgatctcgacggtaccgaggtaggtgaaggtagagaagtcgggctcaacagtcagggtgtagtggacgggcttgacgttgtcggggaggacctgtcggccctgggcattagacgccatggttgatagctagtcgatgtgctagcaccgtccgttctgttaacgtttcgaagcgtagaaggtggatgggctcaggtcatggaggtgtttcgttcgagggtatgggagaaagtcggggagaagggatggaggaatgagaagcagtagctcgggacgaagatgagctggcgattgcttctaccccgccattgaggtggcgcgtgcatgtctcaaagtgctgcatcatagcgcgtcggtgcaccacattatagcaggtcagtgcactgacaatcggttttagtgcacgctacaggggatcgaatgagagtttgtggtgaccataacagagaccggagtgggtacatgcaaggccacagccaatcatgccacgacgataaagctctacccatgctttatcggcattgcggggcaggaggatcacctctaagccgcgctgagctgttcagggaatggtggtaacaccttgacatggcacactaggttcagctctgttgtaagtgctagcaatggctgcttttctgaatccttgggaagataatttcatcttagtatcctgctgcatgagctatggctttggcagagacagtctcaattgtcttggtagagcgatgtgtgaggaaggtaggctccactgtaaagctgcctggttattcacatggcaggtgcaatggtcaaccctctgcctcaacttcttgcacacttcacacaagaaagtcacacgcacccaaaacgaaaacctggcaaactcaaaatctacagaaacaatcacaacagagagtatggctcctctcgactctctgcccctagagctgcaggtcgaaatcatcactaacctggatcccatcggtttgatctcgctcagccagaccagcaggtactttcgaaacgtcatcgatccaaaaaagcgcgagtttgtcgagaggcttttacaactggagctcacagaagagtttggcggaccggccttcgaatatcgcgccagatatttcgacgagctcaagttcctttgggcgagcgagccatggcaggcaatccgctgggcctgctgcgggtgtatgcaactgctctcgcatgttcactttgacaacaggtctctcctccgcctggagttgaggaagccgagttcagaaccctctgaaaagactctcaccaattggcgggtcacgctgcagggcaagaattggagcagccgggatcaacaaagtatttctgacgaggagagaagtcgccgtaagcgataccaaattgcggactcttatctaccatccagttcgttcgatttgtccgacatccacttcaacttggaagctctgcgtgaagatttaggttttgaaggttttgacgatctcgacgaggcgcagttccgcgaattatcaacagaagataggctagaaattttcgaccgaaacattgcatccattgagtctgaacgctgcggcttgaaacggcacttgcgtagatgcaatgagtgcaaataccaaggaaatcagattaggcgtgggaccgatggacgtggcggtacacccacagttcccatacaaatcagcaggaaaatacgtcgcacgcctatcttatatcgatttttccccaactactggactgggttgcgcaccgggagacctccgatagatgagctccgtttggaggaatccgggaaagccttttacatcgactagaccctgcacatggcacgatgccccggatgcgagcgctggcaggaggtgagagcgtttcgtattggggttggcgagagacggtggaggcctggacccgggtttccggctggagctactcatggggagacggtaaacattacagaggctttccttgatggtatccgctgcaacgcatgcttcgcccaagcccatggcagggaggagctcacagcagcctttcgagttggttcttcagacttttggctaagcaccagtctgagcttgagcttgacgcattttaagggtaggataaaattagagatcttctgccgagcttgccgtcagagacccagcctgctgtacagtctattctccgtgccgagttcgtggcatcccaaggctctacagtgctccatcccagaagcatcgaagctcttcagtctcttcatggtcaatttatgcgcatatgggatggtatgccagagcctttggcgagtcagtataaagctcagaatttcagactcgaacgctggtgtcgtggcttcaaggcgcttacagattacttggcgtggttgcacgcaagcaccagggagattcaagagaatcctcaagcactggtagactgggccttgagcccagatggaaacaaatggagccaggatggaaattatttggtctgatcatgagttgctgaaaagtgatcgatgtcttccggttgttcttcgcgccagttcgagcagaagaaagggagaagagcagttactacttagaagtagatacatcaacctggtatcactttagtgtctgctagatgtattactataatttcgtgtggacagagttgagcggtggcagagaagcagtcatcgatatttgacagatatggggtgtattaatgggaggtatggctagattaatgaacagcaaattggcttctgttgattgataatttgttcaacggggtggtgagagtgagcagcgtcaatacaactttgtaaaagcagccggccctccaaagcgtcacgccggtgggagttcctagatgactgcgtgaggtgaagacccggcggagcgttctggaccagactgatttaaaggcaatagcacattaaaggaaaaaacagtagcatgcagttgcgtccttttatttgtaaaagcagagtcttcactgtaggcacgaggaggtacaagaagtttggccgattattatagcgaggtgacatcgttgcagcatgcagagaggcatttgcgcagctttggcagaaagacaaatcatcaagtatttatatttatctagctgaaatcaatcgatacagatactaagtacgtgagccggccataaattatccattaaatgcgtagcagattcgcgaatacatagagttggctgcctttgatgcagaccccatacgtctcccacatcctcatctttcttcctattatagagtttcaaatgcgaataattcaatccgacttcttgtcctcagggaaagtcgccctgccagcctttctgctggcctcgagagcgcccggcagcgagtactgcgtggggacgccgtcgatgcggtgaacgctgttgaggttcttgaccagggtgatctggtaacacgtggcagagccctggcgagaggaaattgtggcggtcgcgaggaagtacttccagatctacgcgcgatgctgcggttagccgacgtgctttttattatgggctgggatagcctcataaatcaacccaccttgaaccacctcacgccatactttgcggtgacctcgtcctcgttgttgagccaatttctgtaccagcgccagagcgtggcagagtaatgaacgccgatggtgtcgatgctacacacgtcagtcagcataaatgccaggcattccaggcgaatgagcaggcctcgcttaccccttgacctcccacccagcgtgttcacagaaggcgacgtagtatgcaaggggggtcgaggcatcggcaccagggaagacgtagcggttcataaacaggccccagactaggtcttcgtactgccacgactgcctgatgccggcaatttgcaggaacatgacaccatcgtcctcgagtaagtcgtagcattggcggaggaaattggtgatcttgaagatgccgacatgctcagccatttccagacatgtgatcttgtcatacttgccctcggggatatcgcgatagtccatacagaagatgttgctctgcgagtcgggtacaccagctctgcggagcgtctcgttgccccaggccgtctggttgcgaccgagggtgattccggtgacattggcctcgtagttgacgctggcgaatttggccagagtgccccagccgcagccgatatccaggaggctctcgcctggcttgagagcgaccttctcgcagacaatagccagtttgttgtcctgtagctgctccagggactcttccttgtccacatctgatatgatgccggccgtgtacaccatgcgtgggcccaagaaccaagcataaaagtcatccccccggtcgtagtggtcccgaacttggctctcgtcctgggatcggctgtgggtcagaacatcggaagcgaaattgaccaagatgtacctgaacagctcccatgtgaagcggaaagacgcccagtcgtggcggtattcgagcacttcgagagcgtctccgttgaagtcggcatcaccatcaaagtacttgcgcataaaggtttccattggcaccttgtgcgggccctgatacctggcgcggtctgccggcttgtggaatgtcagataatgctccacggggagcccggggcatcggactctctcattgatgggtggtgatatggacgaggcaatcctccagaaaacgaggaggacggggacggtcgttagagcagcgaagaagagtgttgtcttgagcccaccgccgagcttccaggcaaggtagtttggtgctagaagaagcaagaatatcaagagcttgttggagaagtttcgattgccggggccgtcggcggggaggggagggttgtggatcgcaggggactagaaggatgatgatgagacgtcagttaatggcagcaacgacggtccatagtactttaccgatgtgatcttgactccagggtgatactcgggcttctcgaccttgaagctggacggcacagctgcgggcgtaggtttgaaggggaagtcggggccaatgtcgatgcccatgatgacggccgggctctcgagggacaaggggagctagctgcagagaagcttacgccggcagtagcagcggtaagcgaaaagtaaagctggggatgggatggtgagtaaggtatgagctagaagagagagaaacagagagcccaacattttctaggaagaaggaggaagggtggaagagagcacgtgcctacctatgctgcctgttctgcatggcgtgttaattacagcgcattacagtgcatcagtgcacatgtttgtgccaggcggccgctgggatggaagatgtatagcacctccttgccgctgcttgttccgggagtccagtaaaacaccccgacgtacagcatactcccccaagcccacagttgatttggcggtctatcattgatccaacgtgatattccactaacacttcaaaattgttctgattgctggctgcgactctcaccggttgcctcattggaggggaccatcttgtccggctcacccaaaaaccaaaagtttgagaatttgggtgcccaagcatatgaaattgtttagcgttgggcgctggtgcatctgcgagaggtggcgtgcgtatgtttggttgagatgtgacatgcaccttgacaaacttgcattacaaccactcgatgcatatcaacggccgatctttcggcccaaagagacccgtggctgcctacctacacgggtgggtgcagatccaaaacagtatgtggctgccctgacaccatcttcaatgtgcatacagcacatatgtatattcactcgcatacgggctacatacgttgtcaacaaatgtacctaaggtacgtaatattggatttcaagaataggtacttcttgctcgctactactccaatttactgttagtagcttacgtttcactacaggtcctactactaagaggcctgactgaccggcttgccgccacaccattggccgcgttcatcaccatcgcagcaaataggatctgactaacctgctgaacagagctcgaggctaaacctgttgatcgtatttatctacaccacggtcagaaagatcaaggaagagtctgacttacctgccagaggctgcggctgttgatcctattcgcgagaatcagcgtagatgggatcaaacttacctactcgaggaagcccaaggttgtagatgttgatcgcatcagtatcacaggggatgcgttcagacttaccttcttgaggcaggtcgaggctgcagctgttgatcgtgttcatgaaagtcaagcaaatggaatcatggaagagaaaagaagtagattcctgctgctttgggcagggtcttcaaaacccgtctttagaaggaaggaaggcatgataattacctacttcagaagcggctccaataacagcttttcctttcagcaatagatttcccttctaatagtatttacttctatatagaattacaagccagtgacagcaccccttcaaatattatttttaagcctctctacattttgtcttttcgtttacaactatttgcaacggacagtataaaatgccatttcgatagctatttagccaggcatatctgcatgagattgccaccgtttatgtactgcacatccattcggatagccaagataccaacaagaaacaagggccccccaggtaaataaatagaaaatcaattgtaatagcagcagacagataagtcaattctacagctatcgctcgtcttaacagcaaacacctaggtcagcttcgcagcaatcgctggtcacagcagcagacaggcttgtcaggtcggcagcgatcgctcctcctgacgccagatagcgaggtcaagcaatatagcgatggatcttcttgatcggggacagtcaggtcggcagcgatcattgtctaatattatctacattcgtaattaagtgtcactagttgtttctcaataatagttacaatttcagcccaatcacacattccaccttgccctgtatcatagcaggctagtttcttcacctgtggaggtaatatattgaaccatttccactctgcaagtactgataattgttgtactgtaataggatggccccacattaactggttcatagctggtgcagctataattgtatatcttgtatcccaggcgcgaataacacaagttaagagatcaccgcaaaaacctcctgcaatattcgctaataggttcgctgacattgggataattgcgagaaggtgggcccagcggcggagttctatatgtaatatatttgaacccctttcccaaggatggctccattcatcttcatcaagataaataccatcaacattagagagtgaagctagagaagagatactaggttgttctggtgactggcctgtaaggatcttggctgctgatttagtgataataactcgaatggaaaggttctgatgatctttaaatgaagatataactataggtagtttaattatagcaacagaaccactctgtagctctcacgttagtatataacagagccacgtagatacagagctaggaaaaggccacttgaatacagagaggaatccacataccgcggctagaagcaggtgcttcttaccatcattaactgtagccgccacgactgccgctggagcttgatgtgttctttcgagatgtggtttgtccataatcgcgcgagccttggttcaatggtcaggtttgattttaacaatgccattccatgcgcgcttgacgtaccggtgagcgtattgctaagctatgaactgcagatgattgggctagttgactccccacgatggttctcaacgacggttttaatgatggttcttaacgatggctttgatggttgaaaagcgtgctatataaatgacgcatgtatcagtgtaagtactctggctaagaggctcaaggtactcactgggttggtgtgctcgagcttcgtgttttgaagtgtttggattgaagacgagtgtgaagccaggtggaagagggtagattgaattcgtagtcattcgacgagcgacttgtcacgatggtaaatgagtcatcggtacgaaggtttacagacttttccatccagatgactgcagccataggctagcaaagctctttctttacctttcctattgttctttttcattttatactcaaactctcttccataaccatgagctaataaagcttatttttacctttcctattcattgtgttaagatggcaggtctggcatcttctattatactttatacttgaactctcatcaggctatcgaaatgacgcgaataaacatcaattgctacaggcccgcgccacgccgcgccgctcattacgtagacgcggtatgcctactatcgcgcaggcgggctttatggaggggtagtttttagatcaacctaatgtaagttaatacctgcaacgcagccctaaggtaagcgggctagtttgataattcgtcttgacagcagacagccaggtcaggtctatagctatcgctctttttcacagtggacgggctggtctgattctcagctatcccttatcacagcagcagacagccatgtcagctttgcagcgaccgctcgtcgtcacgagagacaggctggtcggcctcgcagctattatttgtcatgaagaaagacagaagagtcagctagctaggtgggctacaaaaatctatgaaattagaaggcggctgcctttctcactggaaaggaaagcataagagagagagagagagcagttaagctattgaagcggggagagtggaagctgtacatacacacaacacccacaaccacaacaacaaagacttgtggcacacagcggttatcgtgttagttgacagcttcatcacccgcattgtgattcatcgtacaaagaccttcctcgtcttgagcgattgagcggatttagaagaaaggtaattgttacgaaggaagtattataaacgctcgttgtagcacctcttgaggccacagccggcttcgataaatagaggcaacgcgaatagttagtcaattcactcgtcagtcacaagtcagggtctcaattaaatgaagggaaaagcttctaagcatgcttcttagctgtcatgctcagactacatcttcctcagcagtaatatagtttatagatacgtgagtcaagtatgatcgaggttgggcttttacgctttggccatacccagtacagtttcataactgagaaatagtactatctatcccgcggacgctgggctgaaatatggagtcaatccaccctaagcgtcacgaagaaggaatccattgttttgtagtttctggaaaagctgttcgggatcgtatttgcgggacacttcctgcatctttttcaagttctctgcaccgtaactgtggatcacatcctggttcaggtttgcaaagctagcgcagagataattcagtagcaagtcctgagacttggcggatgctgtgagagcatcaatgcacgagtcgacggccttttgggaagcctcgtcgctgccattttgtggccactcaacggtgaacacccaccctgggccagaattagaatcaccgcgtggtcaatctcagcatcaaattgtcaaattaactcacagacttgggaaaccttatccaggcccataatgtttccacctttcgcttcgccggctgtgacacactctggtccaagtggttggattgtataatgcaacatcacaccctcaggaagtgtttcaagagcctctctccaggaattataggctactgcgtaaagctcctctaagaactctgtggtcaaggtgccgacatatcgcctgttaaaggtttctgtaagcatattttacgagagaagaatcgagttgtcatacttcagattgacaccggggtgtgacatgaccttagctagcgaaaacaaggtgccatcggtcgtatcgcatgccataccaatcttggcagcactcacagagagcaaatcaaatgctttgaaggcttctggcttcttctcgggagtgtccgcataaatgagtccaacggcgacaaaagcggaattgaagtttgtgaacattccaatcttggggtccttctccatctcttgctggacttggacggtagctttgttgatctcaacgtagttatcggggttgtagagagtaatattatattgcagcttaatcaaggggtgagtaaagagatcgattttggtgacaatacctatttagccccgagttagaggacagagaagaatttgaggtcaatttatgtgaatgtaagtattcagaacggcttgtagcttaccgaaattagtgccaccccctttgagtgcttggagaaggtcgggattctcttgatggttttggcgttgacaattcttccatcagacaaaacaacctgccaaaagtggcaagaaaacccaaattagcatttataatgggccacttaagcttaaaaccttacctcgaggttcttaataccatcagcgcctagaccatgaaagttaggtacagcgcccatacctcctaactgtcgttagtgatcattattcggcaaagggcaatatggctgagcatcataccgccgattagaaagcccatgccgacggaggagtcacggccaccaatcacggagagaccattctcttcgagccattcgtagaccacgccccagcggtttccagccccaatatgggcggtgctccgatcggcactgatctcacggctctgaagtgagccaagatcaatcacaataccggtctcatcgcagctactaaaccccgggttgaagttgtgaccggtgaatcggaccgcaaacttggtgcctgtctgcttgatgatggcaagagcgtcggcaacctcctgggcactctctacgttgatataggctccagcagagctccagcagttttgagaccatggctggttggttaaagcttcataggatgcggcagctgatgtgataacacgatcaccaaaagtacttttgagggtctttaatggtggattgcacgtttgcagacatggtgggtatcgcttggtaacgcgggttccggccagcacttttcaaagtctttggaacaaagctctgccactgcggcacggctgcgtgacgctgcttttgtatggaggctatctagcaggctttccctcatctagatatatttaggaacataacaacccgtatcatgactatcttttactggctagcaggggttttaaggggcggatgcctctaagaggcaatgtatcttcatgaatattgctccataacataaacagcgtcacgcactagacctcatcaatgaacggggcggggaataagagaagacatgcacacgcttgacacgctaagctgaaagttgggctcatcatgatcactcgcctagatagaggacctagatacaggacaaagaggtcggtctgaaatgattgctaccttcagcagcagacaaataatccagacccatagcaatggttaacaccaggctgtcctcataatacttccctcgagtcgtccttgcgacgtatgccctaataaattttatgaacacgcatgttgaatgtttgttcctccgtggacctccatggatgtgctaccaggccagggattcacgcattagcgcagcgactttattcaacaccaaggacgcggacagcttttcattgtccatcgagcaccaacagacacctattatgtgctgagcaacaaaatgtactacttgggctgaccacataactacgctaggagatgtaggtccactcatcacacactgtatcatggcgagagtcttgttttcaagcatgccagttgccatttcgttggactaacaaagacactgctaaccagcgtgaacagtaccttttcagtcatgttgcgtttggtttccaccctcaaccaacgtattggcttaacgatttggcggattcaggttccagccgaaatatgacacgttttgtaaggttacggcaagctaattcccggtgcgggagttaacatacctgtatatgctcacatcagatactggagtttatcatggcattcaagattatccccattaggctattttattgtagttcccataagctcggatgtctcctttttgatgtcctatcggacatgctcagctggtggtagccacttgtgagtaagacaaactgtattaccgtcagcgtccccaaaaaaccttccgcatttagaaggttgttactatcttatgtagcggtctgatcgttggcacttcttgactagctgtacttcaaaacgactcttccctcgctgatcacaatttcggcttctcattggaaaattttctttttccttgcgtacttgcgacaaggattacaaacggccaaacgtggaattcccaatgagttgatcgttacttgacgctctcgtgtaattattcgcacccatgagacgggccaacatgccaccattaatcccttcggcttgcgaaaatctaactctggggtttcttttagctatattttttcaactcttgttaattacttctcgtaattgaaaattgtctacgtgtagtaggtttggttgacgtattctataatcactagaatgtgtatcttttcaatctcagatgttcaccacgattctggggttgcaattcaataaagccttcatcctatttcccaaaaactaaagcccctcatgaactaagatggtcaagcaccacatatgagagtgttgctgttgtaaaattttgaatcctgcacttatactgcttcctggtgttatcctatagagatatatgggaatcgtagtggtctcactatcaccatctcgaggtatttctttaatttctgatgcttttcgtctaactatagttgttaaaacaggtactcgattaccctgcatttagcgaacgctgctggtatacaagtttgtatgcgtttcgggctagcatccggcgtgtatttagtgggcttatcctccacaaactcatgaaggattatttggttccagtcttcgtaggcattcttcaggaaatactttagatgccgtggaatttataacaattcatctgttcagcatctttgcactacaggtatattcagcccctgttggatgaagttccgccacatgtggaaggtggtgtggctggagacttgtggctcaacttgtggcgctttctctcaaagtcttgttgagctaagaagggtagcgacgttaatttttaaccatcaggagatgttcacaggactaacaaagtgatctagttatatgtggatttaaaattatcttgaatttacctctgaaagacccaaatgatcgggaaagtaattttattcatgtagagaaaggtttctcagctgcgctggagcaaggaatgttcatcacggaaggtatagggtaggcaacatcctcggggctttcgaacactccgtccgatctaaactgtctcgggatgtggagggatcatctgtctcggctgtcgctgcgtcaaagatcaatttgatgtcactttgttcctttctcagtatgtatcttctgattatttgtagtgacagtatagtagaactggtcttaaggaaactcagctcccatcttcgatcgctcccatgtagcggaactaatctcaagcatttcctgtagggtccactagggtatggtacccaagcagcagattcgcctagaggaagccggggctagagtcaggcttgatgaggatcttgtagcatgtgttgggttatgcgagtggcggcgaatgtgatactttgcacagatcagacttggccgtggacaaaacaaactcggttatttcctctggacaagcggatgggtttcagaagaggcttattatgctgatttacctggtactacctcgtatcccgctagtcccctcgcttacgcatctctaagccatccgttgcgcattgatgacccatttccagggctgtaacttcaagtgagcacgatagattcaccacaccacacatcgcatcacaggcagctccagccatgcccaacctccaatcctgcaattgcgaaaaacagaaatgctgaagcggaccaggactggctgcatctcctgcaggtacagcagtaaccgtccatctgttcctcgacagtcgtgctcacagacctcgcaggatccgtcgcgtcaaatgcgacgagacgaaaccgcactgccaccggtgcaagtctgcccggcgagtgtgcgatggctacctccccgagggccagaccatgacccggcgcgagatggtcgaggccctgtccaagattggcactctgaggcctgcatccgaggtcttggccggccccaggcaaccggagagatccctggctcagctgccgactcagacgatgctctccaaccgggacttcatctactttgactacttccgccgagcaacagcccccaataccgacgccctgatcccctcggccttctggggccaggacctcctgcagcttgcacataccgagcccgccgtatggcacgcgacgttggctctcggcgccctgcaccggagatgggagctcgagtcgaccggaccagagacggagaatctcgttcggagtgccacctcacactatggcaaggcgctgtccctagccaaggacctgcgctcgccggccaagatcctcgccctgagcctgcccttgattgcgtcggccaacatgctgggcttctgggacgaatcccacctacatatcttgtccgcctttaagatcctcgcacaggattctggccggatgccggatgcgcagcggattgcgtcgacgttgacgcgcatggatatccagtccatcaccttcgacgactcacgctcgccttacccattcgtcgaggctgctgcagtacggagtaccaaccagggcatagcgatggcgaccatcgagtcatactcgcaggcttcctcgacggtttttgcgctgatacgggaggccatgatcaacgaggcggcgtataccgagggtattgtcgacgaagcgacgtaccagttcgtccaggcagatctgcgtgacaagacgcagcgattcgaaagtcaaatggccgagtttgaggctgggcatggcaggtcactcaacgaatctgccgccatgacgatccgcatctaccactgctggctcagattcatcttcacgttggcagtaccctgtccggaatccgacttcgatctgcggctgggctatttccaacgcgtcatcaccctagcttatgccgtcatgaaacgacaagccgtgtcaaaatctgtccagctcagtctggagccggcgctagtagcaccgctgttcgacgtgggcaagaggtctagacacccggctctgcgacgccatggcctgcaactcctgcaagggatgaaccgacacgaggggatgtggagaagcgatggggcggcgatggcgctcaaggccatcatagatgtcgaggagagccagatggtgtatagcgccgagatagtaggaagcattgagaactactgcgcggttcattcgatgcaggaggaggcgtcggcagttccctgggacgcgtgggcttctccgggctacgaaccacctaccaactattcgtggctgggcattgatcctatccctgaagaccagcgtgtcgcgatagtcagggttatgtcgcgatttgactcgaggcagctggacctggaattggtaatgagttcgtctaccccactgcggcggtctggaccctcgaaacgtgttacaattcaattctaggcacatggctggcccttctgtctactccgacagatagattgcgggaccttgcatgacccgaggccggactcggaaaatatctctggaaatgatattcagattgcttctcaaggatactggtgtatgggcacctttgggcaaactatagatgtgcctttcggccaaaagctggcgactcgggctcgcgagatgtgttaatttccaccgacgggaggattttgagaccgataatgaacgtactatgtacataacaatacgcgtgggaggattttacgaaacaaagagcaatttagtctcatgcggggtcgacccaggttcaggagagagttgagagatgcttgaaccactcgagccgaagagaaggtgtcgggttattcagcaacccgaactcccgtctcctcacgaccccaagtcttgtctcaattttcattgggctatgtgaacttatgcttgggctgtagctatcaagagcgtgtacgagaagctcggacacttgactcgcggctgcttcgactggctgttggcccgacgtttctaaacccctaagtaggacttctagattgggccgtcattgacgaatttctcatatctgtttttgagactgtgaattgcggctagatatggaggattagaagataaaccgtgtcagctgtcatttttagcccttgtttctcgaccaaacccaatgcacattcatttggcgccatgcgtggccgtgggcatcctgttcactcgagtagaacttgactacgacttagctctgcatatttgatcatcccagtatgttttgcaagtgaaggccatcaagggcttcctctcaaaggacatggagtcgtatctgatcctctgccctcttgttatcttccgtgtacttgagcaacagaagtagaattaactatgtgcatgattcaatctgagaggtttcccgtgaactgacgaaggagtatttcgtgaatatgcatgtttagggcggttatgagccttggattctcaaccaacaaccagccccaggatcaatacgaaggactgcccgccaggccccggcttttcgcgtatctgctctctccaactcttatatcaagactggttgactttctaacagaccttgattttttttttctaaaataaaagtgagtcaaacttgctggctttttcctttggtgcttccttgagctatttgctatcgccgagcatgttgggataacggcctctaagatctggaagctccttaaggagggcgtcgttttctttctcgagcaatttgatcaaatcctctggctcgtgtcgcgtcaaccgcatttgttatctctccagcccccagacccttttgtcgcgatctcgttgacggttcttgaggcttgcaatctcaatacccatacttgtggtctgttgtttcgggtttaaatcttgtggagaacattgttgagtgagacatggtctttcttgccgtcgtgactttaggatgaggtatacgcctagaaaaagatattgagtcatcgaacttgaaaggggaattgaaacagaaggaggtgcgagtgcaggggaatgaaccatctggctcttagttgagaaggggtagaatgtgggagagctggagtgttggcttgagcaggactgatagatgccttctcaggagtttactgaacggcgggatagacaattgaagtttcgcaacaatgtatggaaacgttctttcgggatagatttcatagagaaaacgaacaaaataaaataagacatatttggtagttcatcgacttcctaccgagtgtgacagtcgaacgtctgtatcacgttgtagctgaccgaacggttcaaacacccgacaactcatggcaaggtaccaatttgtccccaatggattggttcgcttcatcgtgtactacgtaattattgaaaaattcaagggtgcaaaggaacgccatctcaggggcaaatcggagaaaacccatccacgtgacaacaccacatcgatgaaaacaatgcaacatcacgctcctccgccatcatgggtcgtcttccttgatcgcggcatggcggatctggtaaatgtccgcagagtgtcggcagcaagatgaagccgctgactaaaagatcaacagtgaaaaacgtgacttcaacaaccagagtagattgagactggtcaagcttctatcgaattgacatcagcttgcgtaactattccccctcatgcgggtgactttttcccgcaatagctcgctgaggtctggtgctgcgacagagtgcgctggctcgggacttaataggggccgacaagaccaccaccacacgaacacctgcaccccctctcggctggtttgcacattattggtgccgtacagggctcgccgtggctagaggcgattgctggaggccctgttcacggcccttgcgaagtgtccgacaacccgatcaccaccggatgtaaccccataccgtgaagcaatatcacctgataattaattgcgggatgtaccccagcatgttccatccagattgtatatatttaatttttatctatgaagccaggcgccctaacattactccgatctcgctaacatcacgataattgctgggattggaccgagatggcgagtcctcgcgatcaaccaccggccacggtggacgactcggacgaaacaaaggaagtttcaatagaacaggagcggagggccagcctcgtgcaagaactcgctagaacctacaccaaccagagccgagcatctgcccccggcggtgctaccagcgaacacaatgaccacgtctttgacgcgcagtccgaccctgactccccgctgaacccaaacagccccaaattcgatgcgcgggcttgggccaagtctttggtcgccttgacagagtccgagggcacttcgtttacatcgagcggtgtttgcttccagaacttgaacgtgtttggatacggcaccacgacagactatcagaaggacgtggggaatgtgtggctggagggaattggtcttgcgcgaaaggctctcggccatgggaagagtcgcatcgacatcctgcgagactttgacggcgtcgttcgcagcggggagatgcttgtggttttgggaccgccgggctccggctgcacgacctttctcaagaccgtcgcaggggagaccaacggcatatacttgaacgatgatgcgtacctaaactaccgaggaatatcctcaaaggaaatgcataccaaccaccgtggagaagctatctatacggctgaagtcgacgttcacttcccaatgttgacggtcgacgaaacgcttacctttgccgcccaagcccgcgtgccacgacatctgcccgcaggcgtaaccagaccgatgtatgcaaaccatctcaaggacgttgtcatggccatgtttggtatcagccataccaagaacacccgggtaggaaacgagtacattcgcggtgtctctggaggagagagaaaacgagtcaccatttcagaagcatctctttctctggctcccgtccagtgctgggacaattcaaccagaggtttggatagcgccaacgcaatcgagttctgcaagacccttcgccttcaagcagagatcttcaatacgacgtgcgctgtttccatctatcagtccccgcagagcgcttatgatctcttcgataaggccacactgatttacgagggccggcaaatcttctttggccgagctgatgccgcgaaacaatatttcgtcaacttgggttttgactgcccgccccggcaaaccactcccgacttcttaacctctatcacgagtccacaggagcgtattgtgcgtcctggctgggaaggaaagtcacccaggacaccggatgagttcgcagccgcttggaagaacagccaggagtacagagagcttcagaaggacattgaaaactacaagtctgcacatccagtcgacggccccgacgcaactaccttccgagcgaaaagagaggcccagcaggctcgtggacagcgacccaagtccccatacaccatgtcctacgtccagcaggttcttctttgtctttggcgcgcatatcgtcgcctgatagggagccccgacatcacgattggccagctcgtggggaatgtttcgatggcattcattatttcgtccgtgttttataacctcccaatgacgacggggagtttctaccaacgatgcgccctgctcttctttgctgttttgatgaacgcgtttagttctgccctggaaatcctgactctctatgctcagcgtggtattgttgagaagcacgatcgctatgctttctatcatccgtctgctgaggcgttcgcctcaatgctcatggacatgccgtataaaatcagcaacagtatcgtgttcaatctcattctatgtaggactctttacttccatatacaaacttggtccttggctaacattgctagacttcatgacaaatctgaggcgcgagcctggagcattcttcttcttcctgttcacgtcctttttgactgtcctggtcatgtctggtattttccgatcacttgcctctgcgtcccgaactatgtcgcaagccatggtgccggcagctattctgatcctggctttggtcatgttcaccggtttcgttatccccatcgactatatgctcgggtggtgcagatggatcaattatatagacccggtggcctatgcatttgagtctctcatgatcaacgaggtaagtcttctattgtcaagtttgatgtgggcaccaattcgctaatgagaaacagttttccggccgcaggtatctctgcacctcgttcattccaaaccccgacgtccctggataccgtgacatacctgacgcaaaccgagtttgctcagctgtaggatctgtttctggagagtcctatgtccgtggtgaagactatattaccaagtcgttccggtacctcccaaggaacaagtggcgtaatatcggcattctctttggatttatcatgtatgcgctcctgctagtctcttttactcgaaataattgaatgctaaccgatcaacttatagctttttcaacggaatttacatcgctttgacagagcttgttacagcgaagaagtccaagggagagattcttgtgttccgtcggggctacaggcctgctcaatttaaggaatccaagggcgatttggaggctaccggaggtgcacttacaccggctgtgcctgtgaatgctgcggttacggagaagggctctggaagtgagaaacagaatttgaagcatgtgaatgtgttccactggaagtaagtaatttcgatacacgtctaccgatgactacttctgttgctaacctgcccgtcccagggatgtctgttacgatgtaaagattaaatcggagacaaggcggatcctcgatcacatcgacggctgggtcaaacctggtacgctgacggccttgatgggtgtttctggcgctggaaaaactactctcctcgattgcttagcagacagaacgtcaatgggcgtaatctacggcgaaatctttgtgaacggccaggttcgcggcaaatcattccaaagaaacatcgggtacgtgcagcagcaggacttgcatctgagtacgaccacggttcgggaggccctcaacttcagcgccctacttcgacaacctgcctctgtcccgcgacgcgagaagctagcctatgtggatgaggtcatccgtctactggacatgcaggagtattccgaagcagttattggtgtgctcggagaaggccttaacgtggaacagcggaagcgacttacgattggagtcgagctggcagcaaagcctccccttcttctgttcgtcgatgaaccgacgtctggtcttgacagtcaaacctcctgggctatcttggatctgcttgaaaagcttgctaaaagcggtcaagctattctctgtactattcatcagccatctgctatgcttttccagagatttgaccgcttgctgttcttagcctctggcggcaagactgtttattttggcgatatcggtgaaaactcccacgttttaacctcgtactttgaacgaaacggggcttccccttgtcctcatgacgccaatccagcagaatggatgctggagtcgattggcgcggctcccgggtcacattctgacatcaactggttccagacctggaaggatagtcccgaatacgcagcagtccagaccgagttgcagcgcctcaaagaaaagccagctgatctagaaggacaagcttcaaacttggccgatcaccacgagtttgcggtcccattttaccaacagctcttcgaagtctgccaccgtgtatttcagcagtactggcgaacaccgtcatacatttattccaagattgctctttgcgtcggtatctcgctctttatcggtaagtgtgagctgtcgaagatttggcagggatgatgatgctaattcatttaggattttgtttctacaatgcaccgaacacaatccaaggattgcaaaaccaaacttttgcagtattcaatctattgacggtcttcggtcagctagttcaacagacaatgccttatttcgtggtccagcgtgacctgtacgaggtccgagaacggccttccaaggtctactcctggcaggtgtttatctggtctcagatcatcgttgaaatcccctggaactcgctcatggcgttgttcatgtttgtatgcttctattacccaatcggattggatcgaaacgcccagctcaacaacgaggttgccgaacgcggaggtctcatgttcctcctactttggggttttatgatgttcacttcgaccttcaccgacttcatcattgccggcttcgagacagcagaggccggtggaaacattgccaacgtgctgttcatgctgtgcttgatgttttgcggtattctggccagcccagactccatgcctaggttctggatcttcctctatcgggtatcacccttcacctacatgacatcctccatgattgctaccgccgtggcgaactcaaaggtggaatgcgcatcggtcgaattcatgcagttcgcccccccttctagcacaacgtgtgggcagttcatggggccttatatgcaacaggttgggggataccttcgggatgagaatgcgaccgacatgtgctcgttctgcaccattagcgacaccaatgtctatctcgcccagtccaaggtgttttatagcgaaagatggaggaatttcggaatcttcatggtgtactcagtctttaatctgggcggtgctctctttgtctattggctcgcgcgcgtaccgaagaaatttggcaagaagaagacggagtagtgatcggttggatgcttctattagaatataatcatttaaatctactacgactcgtaataataaatcttcgtttgtcctaccttaatgaatatcgacgaggctcctatacggcaacagctgttggactctgctcgggtgcctcaaggagacgtgcaagacagtgccgttgagacataggaaggacttgacccgaacatgcggccttcggaatgagccttagagggcattaacaccgacaagatgactattttctaggtcttcaacgtgtgagccagtatcttacctcaggtccatgtaacattacatcgtaatgtgagccaaaagcatggatatttcctccagaacgacggtggaatattcccgaccgacttggttatgcagtcagcagcttcgcattaagtcgcatcccacttcatcataggctgtgcccagggtgtctcggcactcacccactcttccaggcaatgtgggaatgtcgcgagaaatccacaaggtggaaatcagtcgtaaactgttgcagatacggcgatgcgcgatgtggatgtcttcctcagtaagcagtggcgcttcctctcccccccgacagctgaaagactcgccctcggtcgctccggcaagacgtgagacaatggcacacagcagcctccagaggacatacggccaggattgatcctcgtatttttgattctcatggtttcttagctgctgatctccgctgccgccaaggaagaatcagagcagctggaaattgtacgaggtggcgttcagctgcatattctagcgctgaccttttttgttttctcgtgcatgcgagaggtcttgattggagaaccgacagccgtctagttcctctctggtcacctggcttgctcagaagagtgatctaattagtgcctgacgaagtattgtgatagatctcacgcaatgacaagcagcttcatgctgcgggcggatgctactcaacgtggctgagacaaggcgggagttatcatgactcatttcgtattggttctcggttcaaccagactttttgtacggagtatacccacctattgaacatggtacattgtcacttttaggacggggttgaccgtcctcatcaccgcttgatccatacaagacaaccctaagaaaatagtatatatatctcaacacgaccatcggtttccccttgtcatcaacaatcatctttctaattacttaacattccaagaagataatataaaccaaattccctaaggcttttcactgttctacaccattccaaacgcaaaatgaagtttgatcttctcgccgccgcccttgcaaccgccagcacagccctggcggtgcctgctccctgggaggccttcaagctccgcgcggtgagcgacagcaacgcgcagctaaacggccagttcctcaaggccaagaccggacgctactacttcggaccggatccctccaacccggtttgtgagggtggtagccaagatgatggcactttctatctgaaggatgggtccgtcttcttctacaataccaaccccagtgtcactccccagcagatgttcactgaccgcagtggcatgggtaagttcatatcacgtttctcttcaggtacctgctatttatgactgaccggttgcaggaatgggcgttactggctatgttgatcagggctctccactgcccagatacgcagaggtcaccggctgggccttcaatagccaaagccgtctcaacatctatggcaatgagtggtatgcctgccctcacccggctacaaacagttggagcatctgggtctattcccccaatcccaaccctggccacaaccagggctgcatcaagatttctctggagcgtgttggcgcgtcaaatcctctgagctgcacttattctaaataagctgctaagacggaatggtatgctaaggggacgacagtagaagaagagaacagtgcgtgatctgcaatcgttgggcatacttgataaattagatccatccgttgcgcatactcacaaatcaggttgacggtagaggttctagcattagagtcgaatacttctgaagtgacatgtattctagagtacagaaataaagaacacgcatacgcatttagatgatatggcaatgtatagaacctagttcacttcgactgtagatcccttcaaggcaaccctaccaaagtgtgagaagtctcaatcagagattgaattcgtgatgaagcgctgtactttccattttacccgaaatgaaatttgagtcttcgcagctattttaaaaagatgaattcgcctcctggtgtaatgagcacgtacttcccttctcacgagcaagccggacccaggaatgatcaggtaaccaaagaattaaggtcttcagatatggcagtataatttaatgcttgcgcccatgaacaacataatttgagattcgctatttatgttggcagtcggcggattggaacaaagtgagcacaaactgcaaaatatacggtcattttcaataatatattcattgtaagatataatagatggtgcttgctgtagatgatcaatgatccgatggtaaatgttccataatcaaagcgtcgtggttatagtgcttccgtagatacaagcatatagcctcgagttccgtcatagcccgaagattaatccaccagacagacttcctcaccctgctgtaccacaaggcaagtagcaacaaggccacgggatccttctttagcagaagaactttgaaatctgggtgtccatgtgtgatgaatgacatggctgcgggcatcgggatgttcgcaggctcaaagttcttcaagttagttactgtttgagccgcttggaagtacgggttcgtgtcctgtcggcttgatccgtcgaggccgcacacttcatacagggacggggagatggtggcgattccgctggctgagatgtttgtacgcatctgtgaatacaggtttgagatgggataaaagatgctctccggtcgatccgggttggtgagctgatagagcttccattttgtatctcccatacgtagccaatccagatctgccgtttcggaccctttgaatggccatgctttggaagggtcgctttcgtcgatggctaggaacaatagtatgctaagccatgacgctgtggcccatatcggatcccggtctattggatggatgccttcacgcaagtggcgttgaaataacgttgtgcattggagaaagtgcttcatctctcgtacagttctgccttggttgggtttgcttgccgaggtgagagaacggtcgtgagcgagagacaatgccaacgtcgcatgcatcaaaaagggatactgcggatggacggctggtcaacatgctgggtgcgtgcttaagcataggctggtatggacttacactttgtgtgaactgcaaaacatccttggctggaaattcaaacctcgctttgatttcctcgtaaaaccgagttataattctcatcgacccggcatctagttcgatgacgacggacgaagtcctagacgcaacttggctagatacgcgttgctttaagggtggaattggagcctttgcccgcggcgttgcgtcatatgttgttccaaaccactgggagtgcgcctccttagaaggcagcaggtccgggatactgataccgtagttacatacgacgccaaatgatagacagcatcgacactggggtttggcttgatcacacttgacgagttaggcggtaactttgagccgtggcttgtggtgaggcttaccttgatcttgcgtaatttgcagtttctacaccctcctcttgatcttcggaaaacacggctcttcttcacagcgacccttggttccatgtcggtgaaggtggcggtcttgataggcatggtcaatataatcgagaggattttgcgcagacgctaaaccaagtttcgcttgcgatagagattcatttgtccaccgtcgccgggatataatttataaagaaaggagagtccgagatcccaattgaaaatacggacctgcgaagaggaggcccggttttaggccgtggaggtcgccgatagctccggatccatgtcaagtggaatcagcagtatggaaacgtcttgagctaaccctgtttcgcataatgctgttgctctattggccctgggagtcggcacatcccattccttgtctgccgcgggcattgtgtatgtgggtgcttgtggagggcagatgataggacgctaaaggtagagtacattcattccctctattcggatatatgaagtacctgattggatctggcaaatatggcgttgaactcaacttattcaacggctctaactaactcatggctgtgtgagaaccaaacttgacatcatgaggatgagaaaccggtataaatagtcgaggcatcatctctaacattcgcttctcatcaatacaatcgaacagaacctctgattcaagcgtctttcaaccctcttcaagaacccagactacaacttctacctgccacccttacactatgaaggttttcgtaactggcgcatccggcttcattggccaagctgttgtccgtgagctcctcgaccacggccatcaagttcttggtctggccaggagcgacaagagtgccgaagccctaaaaaagttgggagccgaacccgtacgaggaactcttgacgatccggagatcctcaagcaagctgctattgcctcggacggagttatccacctcgccttcaagcatgaagagatggccgactatgtccgtatctgtgacgaggatcgcaagactgtcacgcttctctgcgaggccctcgagggcacaaacaagccattcgtcggcacctcgggcaccctcactgtggcccatgctgacttggccacggaaagcgatgtggccgacttttcgaaccctgtgtcttccggtcgtgcaaagaatgatgccgtggccctcgaattcgccagcaagggcgtgcgttccacagttatcagactgccgcctaccaaccatggtgagggagatcacgggtttatctacatgatggctgccaaggcaaaggagcagggagtctctgtctatggcgacaagggagaaaaccgctgggccgctgtccatcgaaacgacacagccaagctctacagactcgtgctagaaaatggcaaggcgggatcttactatcatgccgttgctgagcaaagtgtaaccctcaaggagattgccgaggcacttggtcagcagctaggcgttccagctattagcaaaacggcggaggagacgtcggcgcatttcggcttcctctcattcgccatcatggcggacaacgccgtttccagcgagaagaccagaaaagagctgggctggactcccgttcagagatcgctgctggatgacatcaaggcgggagtataccgcctggactagtggtttgttgacaatgaaattggtcttgccaatcgttgggtgctgtaaagggggatcgacaggtttagctcagtctactgcacattattctagctttaccgacataaatattgtccatttggaattcaagtgtctcaagaaatgccatcgtcaatcctacctataaaagggatatgtttgaactcttggccccagaggaaaatgattgaatcgcccagttttgctgtagagctaggccggtagccaccttggtatgaagtgtaggccacttctaagcgtagcgtttatgataattgaagcatgagtatctgcaactaccgagagagtcgaggggcaagatttctgacacaaccacaggcctttaattgtcagactacaggcaatcgacatggcgcagtcaagtcaaatcatgaacatatggacacgttaactcatggtacgattaagcattggctgattcccagacttgtacgatcgatacttccatgcccaaccacagatcagtggacaggctgaggctttggcaccgacgtttatgaccgtgcaagtaattgatatctggtcttatgctaaaagcttgttcacaatcttaatattactttctgacctgatatccatacaaaggaaacccaaaaaaaagtatcgcaaacatgagacattaaattcctccttcctaagtgatgcttcataggccctggcaatgctgttccctggagattcccttctagaatgaaaaataccaaagaaatgctctatatgctgccttgattacatgcaatgaatgaaaagagaaaaaccagacgagaaaagtggaagaaaacaaaagaaaaacagatcaagaggaaaaagaaattgtccttcaggacccgattactgcctcttcccatccaactccaagcgactagcggaactgcccattgccgatgcaatatgcggctgtgggaatatcaaacaggctcggtttcgaaaggatgatcacgcatcctgggaatcgatgagtcggcgaagaagatgaggcagcctccacaggacggcgccagtacacaccgccaaccgtctgtgaagatcgtaagtgacacgctggcaacgtagacaatagacaacgggagacgcacctatcgaaggtttcgaggaatacggggcaatctccctgcaaccgctctcgcagtttcttcttgacctgcgcttcaagtcggagattgagagaaaatccgcccgtcagaacgatgcactattgataagattagttactaacggtctcaacaaggaataggagctattgaccttgacgttgtgttgcagactagccgcttgttggaagagggcctcaatgaggcttgccttcgcttcggcggacttgtcaaagatctgttttagggttcccctgtgcgcaaggtgagcagaagtcttatcaagggaaagcacatgtcccctccaggagcttattcgatcattgggagatttgcagttgagatactgtgtcatatgggagcagctgcttgttgggggcgcagaaaagagcaacaatggtagatcagagaaggaagcgtgatgataatgaaaaagtttgagacagcacacttacactctcataagcactcttgtctgaccgaccgagaaactggcctgttcatagccagggttgagacccgtgaatgtcttcttagtctctctctcccagacctcgtttgcatcatcaaggctaggtacctcctcctgatcacctgcaattgcgcgccacttctgaagaagtagggcacggaactccgcatcggctgacatcgagccagtgtaactagagttgtgcagcatgcggcggtcaagcaactccaattcctcctcttcggggtatcggagtggtatagagtcaggataaggtacgacggcggcatcctggaccatgttagcaaatgggaatataagtaggatgatggaagatggtgaactcacatctgtcatgccaccgaagtcagcgacaatcatagaatcgccgttctaattcaatcaataatcagttctcctcaatagcgaaatgattgtgtgcaatcaacaagacttactagctccgctagaacattgtggtgctcatgttgcattgtggtaaccactgccctgtgttcagtgatataacgaacacgacatgtacgacaagcatgatcggcaattcccgcaattcggacagcggaccggaacatactgagctcttcgggagaccaggatattgggtacgtaatggtgatggcagggcgcagtccatcgtgccaggcgtccagacctctggcaacccccaaggctttctcaaagaggccttttagaaatttcgcgactacgacgtcttcatcaggcaagtccaggccgctccatgagctgtaaaaggaattgaccatacggttatcaccgcttctcggattggtctggttcatcagtaaggccttgagatgacagagtctgtcttttcttagcatcaccctatcgggagggtcgaactgaagctcaacatcgttctctccatggatgacatgtagacttgtcggaaacttgcgaacgaacaccatgttgcgggtactgtagccatcgactgatggcagcagtacagcagcggccgaatacctacgcgattaaagatcagtggggggcaaaggagggaagacagcgaaatcctacgttgaaccgaagtccaacccaatgacgccatgagcgcatccgtagatacattgattctccatggtcgaggcgagggttaggtgagcaggtgaatagaacgctgcaacagacaatggataagaacgaagaggaggacacgcaaagccaagcgcgcagagccgtgggagtctgtgtagccttgccggaagagaaatacagaggccaagtcaccagaggctgggattgcagtcacgaaggggagaaagggggcggagatccaacatatagatcccctcagaagatgccttggatcagcgacgcttgtttagccaagtttctatccctcaccggcccgatccccctgtagactttccataactccgatgcccatgtagcgagtggcgtcgattgttgtgagctagacaatggacttcctaggaaatcgagccatgtgtaacttgactagctgtgcgaaggcgttcatttggtgcagagaggcccgcaagcgcaatataatgtgtcactactaatcaccgccatcacatccggcaaacgcagctgcacattagaccctctaaaagctactagaagagaagagaagcttgtataatatttcaatttatctacagctaaaaaaaaccccagctttgatcgggctttttttacccaacttcttaggtaggaggggcggacgaatgcacgagacagggcttggcatataagccacaaccacagggcctagccaatagttcacaactttagctacctgagctaataataggtgtgactgtgattcatgggagctgtgtgtgcccacagaccagagcgagggagggaaaaggggttgctggggatggggatggtctgtgagatgggttctcgtgcaacaaacaaagagggacgaaggtgtcggtgggtaattccacgctgtatttctacctgatcctcccacatcgtctcaacacttcctttccctccggcatacgaccttatcgtgggtgaaccaacccaaccaaaatcaaccaaaaacaagtcttttcagtctatatctcctcacctaatgaagacaaagccgagaaagaggtccatgagccccaagacccgggtggagcagtcttccaaggcgtcacgaagcccaacacggcgagagaatcgttccagggccaaaaccagagagaacaacatacttcttgagcttgacaaagcatcgaactccacagagatgtcgcaagtaggccatacccaactgagtgaggtgtgcaagcccctccagccagccgcttcaaccctaccgagctccgcctctctcctaggctctatatctccaggccaatgggataatcctccggcagatagtctacccgtgtcccctgatgtgcctcagccgggctatccgtcctactctagccaggtggaggcggcccaactagaactggatgagatttattcgcttgacccatccgtggatcaagcagaaataaaacgttgggaccacaaggcgtttcttgaggggtcttactaccaccaacctctgcacgatctttggtgcaagcttagcgtctacgtgaacaatttcatctccgcttcagcaccgataaaatgcatgtggcacctcttggacgataaaacaaagggagagctgatatcattttgccctctttcaccgagaattatcgaagatggcaacaaaggctgccaccatctcatgttggcttgggtctggcgtattctctacgacaatctcctctctccggactgcactgattaatggtcaaccgagggatgggcccatcttggatccttccaccagtctctgcgaagtaagtttgaaatacccgccactgcttggctcaggtctaatgctcaatgtgttttagaaggaggcttgcccgatgaaagcaacgctttcacccatgcgtaccatgctgccaaattctggagcgttcgcatggcatacatgcgctttgggccgcatacgtctgtcgagcgacttgaaaaagtaattttggatgaattccttccgatgatgaagctgcgcaatcacccagagaatcaaattgagttaacggatagcgaatcagcttcggagcctgatattgatcccgaaacgggtctctatagcaaggtcaatgaacttctttctaaagtgacccaaaccgccgtggacatggacctctggatacttgcctctggtaagaatgtcagggtcgattttcgggaccctgagacggggaaggtgtcaggatttccttacaagccagactccatgtcccccctaaacaacctgattcgaacttcagcacgaccagccattggcgctccggtcgatttggtcgtcgagccgttgctgcgttcattcggcgagcgggctactatctcttgtgaaaagcctgggttcgtggatttctacccgtcagcatttgggatgcaccacaagtgcaccgaaatgtcgaagatgtgggtagtcgttgatcactttgatgagtatgaaggcggcgaagagtccacagcttgtgagtagaactgagagggggcttttccgatgcaaaggcagcgcccgtcaagaaggagaaaagtgatgaagatgcgagccgcattacgattgtctgattgtctttctgttcgatgtcattcgcttgttttcccttgtctctcctctgaggacggggagaatttggcacccgattttaattctctctgtagtttagcctaattctgtcagccattcatcttctcttgtgcatttcgcccctaaatcatcacagtagtaataatgcaagtatatttttatgagtggtgcatattagcattcaaaggtttagtgaagttcgggtccagggtaggccgcttcttccaaccctcggaaatgactctcggactcgcgtgatccaaaaataaacattgattgcttcaccatcagctgcccagtgggttcgtgagaattgacgcctcatttggacgccaaggaaacagctgtcagtcagactgcttggaatcagtctcgtcgaccacgtgacaactgatctgctcagaggggtcatttcacagacttgacgcatccccactccccgacattgtagacagttcctaacaagatccgacccgcttgacagcatgagttgtgccgattgggagtgtttctgcgccatttgcggcgggcctctacgggacgtgagctatttcatcgacgacgatgaacgcagatcgcgccctggcccggacgcgtatagcccagatgtcttcctgacccgacctgaatatccggagctggaatggctggctgacattcgcgcccttggagagaatccagagaccagcgcaccgtcgacgtaagtctcatggatgacgagaaccgtgaagctcgtgctaacgctgtgattgtttggcttggccagtgtctggctctcaggaccggcttcggtaggcctcgacggagacgttaggttcgggctcgacaaggattccgatccggctctacaggacatgccagatgctggatatatgcaggcgtaggttggcgccatttcatttgccgcttagacgtgatggaaattgattgctctccccgtagatactgtttggaaggccgccaaaacccttggtgtgcaccatttcacgtcaaatgtcatgaggtgctacgacgctttcttggtgttgagtctctggacagggaggtactcaacgagacattcaaaagtttgggttcacgcgacggatgggcgacgttcctcggaattgactacggagatataaccgaacataggacgcgggattggtcccctctgagaaaccacgaatacctggtatctgacccgattgatattgaatggctggcaagattctacaagaaattgcctctgcgaaaggagggagatggtgaaccaggcggcgcctacaatacgcaaggcgatccattcagcacactcccccttgacatcctctcacttctagtattgtctattccgacgatggaagacgttttcaaagcgaggatggcgtctcctgccattgccaacgtcccattgtctcagtccttctggaagtcgcggatcgtgcctgatatgccctggctatgggatatgcccactccctcagatgaacagcgcctctcagtagactggagccgagtctacaaggatctgttctggggaagccagaggaataggacgttgggcctgtgtaatagaagaaggatttggactcaaatgtgcccgcaatttgcgaagcggtacgcctctatcacggaggccaaaaatcactaggccaacacagttggtattaataaggatcgaagtttgaacgtagcacccgcatcgtattacaaattattcaactttaagcggcggctctcctcgaacctctcgccatttgttcgtggcctcaagcacctcctcgcaccctctgactgaccaaccccatttctccatgaatccctccgacacctcccaacccgtatgatgccagggaggcgaccaaactatcagccctcgcatcccaggttctatagccccagtgcccttcgataaccaccccgcaatatcagaagcgaggtccatctcgtcaaacgtgccaatagctcggatgaagttgtctctccaggctgggtgagggaggcagtcgatccaagccccatgaggaaccagagactgacatcgagtaggcaataggctttcaggtacctgctgtatatttctgaggttggggagaacctgtaaggcgcctccggtacagtcatatctcgtttcgggtattacctcctccaatatgtggccgttggtcatgatggcacgtaaggtattaacttgaatgagggtgatcaaatgatctgaagagagagggaagagaagtcttgagttaaggcgccctttcggaattacgggagcgttgatggcctttgccactgcggccggtagcagcgcgaccttctggttttcctcgtcccagcaaggtatagtgtccctcttgatggcaggcgtctccattttcacggccttggaagcagcttgttcggcttttcgacggcctagatagatttagcgattggtcgcacacttcaacctgggaccgtttctggggggactgacggtatgctcgggtgtttaatctggtctgcctcctccgccgggatgctgcatccgtcataccagtccagtcatcatcgcttactctggcctatggcgtatgtgtcattgtagttcaatatgatgctcagggaggagattaggcatacctcgagcagctgtggcatggcgctgagagttatcgattgcttatgctggctgctactcatcgtgggccggtctcagtgtcaatgattataccgttgatctaaacgcgtgagatgacaaaggtgattaaatgtgagcaggttgcatgtgaaaatttaaggttgttgatgcttgtaaataccctgctcggagtcttcggagttaacgatgtccggaccccagactttctagaacatatagaggatccgatagagcctcttcacctccatcctttaccattttaggtgttcgcaatgaactaaacgtgtgtcggattagtgtgatagtcttgatgttgggaactatcggtaactaagccatttggctctttacggtagagtttagtgattcggacttaaaatctcgactatttagctatctacggacttgaaagaaatctacaatttctagtcctccattttgcgcactaatatatattcttcactcgatttcgtgtggcaaactaagtctcctagacgcaaccatatcctcagtatgctcaatgtccagctcgatcgtttttcgggtgttcggagcgctttcaggcactgtggcgagatactctttggcatcatcaacatactgttgcatattcttgatgtcgtcgtgtatccgattaagatccggctgttttggccagacaagagccaagtgaggctctagaacatcgctagatagcgtctcacatgctgccttagacaaatcgaacgcttttttgtaaatgatagcatctctttttgcttggcgaaactcgtgatccttttctgataatactccttcttcttctatctctcgtaaacgattctgtttactctcatattcagatttaaccatctcaaactcccatagaggcaggtcttttgctctttggcagacccctccaggacaaaacttgtcaaccatttcccgagcaggcgcaagctgcttgacagttctcttctgggcgtgctcggacttccactgagaaagtctcgcagtctctttctcctcttgggaggtcgctttgagagctgactcttttgcccgttggatctcccgagggaaaccctccacccaggactgaagagccgcaagctttctaagaggctcttcggctacatactttgcccacacggcacgggactttctagcctgctcaatctcgaacgcctcaccatcaaaccgatccggccatccgttgttcctgtagattgagggtagattcatatcgtaatggtcccactcgctgccagtgtcatcaccgccgcccggaagaattgtgagctggcgataccacttattaatacccctcagaacgtctggagcagggcggctgggtagatgttcaaaggcgttgtggttgagtgaaagggctggcatactctccgccccctccagcgctggatccgaaccggaccagccttcttgatcaatgatccaaatcctgtgcagccgtacatcgtagataattacgctttggtgatttccgagcagagataacggggtcacccattggcgcatgtatggcccatcctcttcctcaaaaccggcctcgtatcgtggatcaccataaaatggatcccgggcctcttccacgtcgttcgttcgccgaaaatccgcgaactgaccaccccggaagaacgcagtttctccgcattcaacatacggcagaatgctgtagagatggacaattgcaggatctagtctgtagctgttcatagtctcttggacggtgctgaggtcgtgagggccaggcttgatgcacagcggatcgaggtacttcatttcagccagtgtttgatagatttcgagcagtagatccgccacctcttctgtcctggccatctcgtcgcttgataaggggtacgacgatggcctgttcagctggcaattccgatacctcagtaggaggtatctgtcgtcagcgaaaatcaacattatggctgagattaggacaactaataatgctccccatatcaaatttgacctaatttgttggggtggttgagcttcttgatctggcggcgccatgttttgcgtgctggaggctggctttgttggtagacatcgaagtacctaggtaagaagtaattcatcactcggttgaaccaggaaaccacccgcggatcccgctcgcagcagtcggcgtgaagtcgctttcgtagttgtaggagtaaagccgagcgtggattgtctccaattttggttcagggtggagttgcctaattgctgcctggtttactcctcctacataccctagagactcgctctaatacaacaaggttcagctttggcatgatgaaataatacggggatcacgactccatgtaacgtactggcagatccctggtgataggcaagaggcagggtcacagtggcaggcagaacatcgatgtccaggcctctcagtataggtcttttctctttttagcggttgtgaaagtaaacgtgtagagatgttgcaaaggcgagggctcacatactcctatagtcgtttattacaaatggtttccaaacccaggaaacggagagttcaattcttaaagatccaagtaggtagcaaatgatcacatatttcttcttctcttagaccactgttgatctcgagagcacgtggatgacgcgcagtggaccttaaaagatattagcctaaaggtttgcaatatcatggcatgctcctccaacctctagcgggttgaagaagcgtcgtgtataatatctcaaagagaaggttataaaagtctacttgtctatcatttgtggtaagggaacctcttgtcccctggtggaggcattgactgcgccgcataacctgaaaccctggctacccaactaccttcttcggccagttcctgatttgtttagtttgttgcctagtgggataatacactgatgagtcaaggatcgtcctacttcaattcccaatcatttgggaaaaggactggtgattttctgtctatataactcacattggcatctgggtccaaagcagcagatgccatcacttaactggctctgcgatcgttgccatatctttttatattctcagcggccatcggcgaccaggaccaatagttatgcaataccagccaaatgaagatgacgcgaccgacagcgacgtaagcattctcagccctgatgacattcgcgattataatccggatcagatcctgccgcaatccgcaaagacagtcaagaaaatacgcgcctggctcaagcccactccctacgatgtcgttggcggcgaattccgcaggcacctgctttcccatgcgcccggcacaggagactggctcacttcgagcgccacgtatcaggactggctgcacggccaagatcacgggcttctctggataaggggaatcccaggctccggcaagtccgtcatggctgcttggctggccgatgagcttgccaagctaaacccggactgtcctgtcctctacttcttcttccgtcagatcatcgatgcgaatcatgagcctcaagccatgctgcgagactggatggatcagattctgaaatacagccctcctctgcagaaccagcttctgaaatatgtcaatgatgggcggacgacaaagagcatctccatggaggacatgtggggagacctgagagcagcgctgtccagcttgccagggaaagtgttttgtattgctgacgccctcgatgaaatggaccaggataatgatgcgtttctccaagcccttgggtcacttggccagtttatgccagccaaggtgaaggtgttgatcaccagccgacccgtcccaagcgtcgaaggtccgctccggaaaacctctggtctacatgttcgactacaagagaatttggtcgatatcgacatcgcgaactatgttgatcaaatgctggccaaatcagccatacctgaaagggactggagggtaattcgggaagctgttcctggccgagcaaacggcttatttctctatgccaagctcgccatggacgcgtttcttgagctaggagctgatgtcaaatcggtaattggacaactgccagttgatctgaacgctttatatacagatctcctcaatgaacatgcgaagagatccggcatcgaacccagagtccagcatctcatcctccaggcagttacgcatgccacccgacctctccgactgctggagctgacagacctggtcatggtggcgaatcctgacgagaatgctaggaatgtcaaggatactaaaagtcttattcgggctgcgtgtggcccgcttcttgagatccttgctgatgagacagtatcagtaatccatcattcgtttaccgagtatctgaaaggtacaactcgcacgcaagattcctcaggatatccagttctgtcgatcggctcaactcatactcagcttgcactggcgtgcctacattatctccagagtggatgtttagattcccagaatgctggagatgatggttcttctgatgaaagcacccaaagaatgcaatcaagactaaagcacccgttccttgagtacgcagcccagaattggtatcaccatgctaggcagtcggacaacgcgggccacagccaaactgagatcaatgtccagattcacaatttcttgtcactggaaggtaaaatcagaaactggcttccgatgaggtcgtacgaactacccaaggacttggggagttatttacatctccacgttcctgcaaagataggattgatctcttacttccgagaagctctggccaacgacgtaccagcgagtcaagaccacagaaaatcggctctgtaaggccccctcgtttgaagtgccagtcataggaatgtctaaagacaataaaaagctaacgggatatgtctttagtcggagagcagccgaagcaggtcatgcaagcatagtgcaggaactcattgcggccggcaccgatccagatcaggatgatgccgctgggctcaagcccttgcactacgcagcggaaaagaaccaccatgaggtagtcaaagcgcttctggaagccggcgtcaacccgttgactccaaaaaccaagaatgagtcctggtcgggttgtacgccgccgccctgcacggttggtgacacccccctcatgtacgcctgccgcaacgggcacgtggagacggtcaatgcctttctcgactctctggaagatgtcgagatcaagcttcgtgccctcggctgggccagcggtgcagggagatcgcagattgtgaccacaatcttacaagacccgcggcttgatatcaacgccaagtctgggggcaccacaccgctctaccgggcatgtagtaacccagatgcatcagtgatcaaaagccttctcctcgcaggtgcagatccaaatattcattgtcagccggtaaacaactcgggattcgccgtccacatcagtgctctggaccatatctcgaggccagaggatctcggtcttgattccacccaggcatacgtatctgcatttgcgcaccaaaagcaccccaatggagtagagttgtcaagagtgtttccccttttgaagcaggccggtgcagactttcacaagcgtgactacaaaggacggacattgcttcatctcgcagtgcaatcaccactcctgaccggagcacttctcgattctggcgtagatgccaatctcaaggatgagaacggtgaaacacctctccacaatgacgacatcgaagtcgattgcatgacgctcctcatcgacaagggacacgcagatatcaatgctactaggaatgatgggaaatcggttctactgtcgtacctctcgtcctacaagtcccgtgctcatcagcgacttggcaacttatttatatatggcccagactgcaatgtggttgataaggagggcaatggcccgcttcacgtcttgctaaacgattcatctccatccttggacaccattgaagaattactaaggagaggcgccgatgtcaacttgaggaattacaaaggacaaactccgctcatgtatgcacggggacccccgtcagagaaggtgatcagccgcttattgaaggcgggggcagatatcaacgccgtcgatcacaagggggctactcttttgtttcgcagcctttccaaagaaacaaagtacctagagatgctcctaagtcaaggcgcttcattcaaaacacaagacttcaaagcccgttcattgctccatgagtatgtgaaatgccacacatggcgtgagaggacggaatccttcacctatcttttgggccaggggctggatatacatgccgttgacaaggatgggaacaatctgcttcacgagcttgctctcaccgaggacgcccagtgctcctatcacggcaaagaagcgattcgtttctgggaacagcttgtcgagatgggagtggactcggacctgaagaactacgccggccgcacaccgctccatcttttgtgtgctggccagttcaaaatgggctatgtcaagcaccaagatatcactgtcttcgactttgttcttccccgagtgaagaatgtagacgtggccgacaatgacggagttacgcctctgcacatagctgcgactggttcagagcgatatagcacgaggctgatcgccgcaggcgctgatccctcaaggcccacgaatgaagggctcacccctctccatattgcaacccgctgcagagcaagtaacattgttggccgtcttctggatgccctacgagcgaaggaccgggttgaaaactctgcgtactccagcggactcgataatggcagcgagcaactaaagccggtgatgggtgtaaacgagcaaacgttcgggagggagacaagatttactcccctgttctatgcgtgccgatcagggactccagaaacagtacgattgctgctagatgcgggggcaactgttgatctgaggcagatgctcgacgctactctccaattcgaagaggagtgtgcattatggcggacgccctgccaaccgtcaacatgtgatgatgtccccgttaaattatactcccgacttcgacgcaagagaacagatacaagggggtcgtggttttatcacttaatcccggaacagatggccaggctggacgagatttgggttatgattgtgagccacctggccaatgtttctgacatgatgctagatgctgtccgtgaatgcattttgaaagcttctttggcaggccaggactacactgcctcgatattatctgaagtgcggcgcaaatggcagagcaagacgtttgaaatgctagaaatggtggagggcaatattaattcccaaaaacagagccaagcaaagacattgaaactttctggaaccgtgaccccgggtcgagctgagaagggacagatgaattaccacctatcgcgcagggagtatcatctagttgaggagatggctcatctgggttgccttttcctaccagtgcctggcgaatccgatgagaattgtctctcttgcttggtgggcaatgggtattcgtcactgtttgagaaagtggccgagtcggtggcagcatctgttctaccgtcagggctatggcatgcatatggggataatacaaagcccgggctatggttcgcggccaaggatgtttcggaatccagggttcgaggcagcaatgctaaacccctgattgtagcagccgtgcagcgaggactgcctaacatggctattcttcaactgctggtcgagaggttcggcgttgacattaatgagttgcattacaaccggtatctcgtcgcggctgacagtgtgttgcattcgctggctcagagcacctcgtggtggcacacccagcaagcattgccgtatctcatcaaagcaggtgcagatttgaatatccggaactatctaggccagaccccccttcatattgcgttgaaagagtcgaatcgagaggttgccatctcgcttattgaggcgggcgcagacgtcaatgccgcggataatgaggataagaattgtctttcatacgcacaagcagatgccgatatctcgcaactgcttcgggctcgcggcgcaaacacaagtgttaacgagatatttgctgccatcgatgagtccaacgtcgaagcgctcaagaggattctgtctagaaacgagccaggaatcaatgcaaactctcggcgggaacgatcgtccgacgaggacgctgatcgtggcaagcggaagaggagacgaaggaaaccccatgaagatgacagtgatgaagaaaaagacatcgtcctggatgatcagctgttccctttattctacgctggtgtgctgccaaccaaccgccgtgaagacgccgataaaacagtcaaggttctgctagacttcaacgcaaatccgttcgcgaagtttctggccaaatttagtgtgcggagatcaaaagcgtatgatcgtacttacgatactccttcaatagaagtgccagaaggttaccgagagtgcacactagcgcatgagctattccttcgtcatcgtgggaggtatgagaacctcgtcctgcttcctgctttggacgtgaatcatcgagattgcaaaggccggaccttgcttcatgtttcctgtattccttgctggggaccagactctattattaagagcgaacaaggggatgatgcaagtctgtttgagagattggtacgccttggggctgatttaaaggctcgagacaatcaagggagaaatgtcttacaccacatgttgcgccaatgtgattctgataacttcataaagtcattctcacatgttcttgagacatgccctgagcttatccaccaggcggacgacgacggaagaacgcctctgcttgaggccgcaatatatgctgctaggacgaaagagacaaaacctttcaatagtctgctcgaggccggggccgattgcctcactgtggacaagaatgaagaaagctgtctacataagctcgcagagaatctacttactcaaggtcttcgtgaccatttcaaggaccttgttaaacgaggtgttgatatcaatggtgtcaactcaagcggagagacccctttgttcgcattctctcgacgtccgagaaactttttttccaccaagcggtatttcgaaatgaaatggtacggagacaaatattcggaaaaggatgccttgccattactgctgaaacttggtgctgacttgactgttgcgaacaacaagggacaggggctgctgcatgctgccgcgagcggtgatgttgatcggttcaaggaggtcatggaagctggggcggatgtaatgatggaggatgaagcccagcaaacggcacttgacatcgctgctgctagtgataatcaagaggttctcgcactattcgagaagaagagttagaaacaaagttgtggacatgttttcaatgcattaaatttggaattctacccatccgaggtttttctcttagactcccattttccatggacagcatgacacgaataccaaataccgagcaagaggaaaacattcgccattataactcgatcatagagtcggacatggtactggaagaagtagtactctggagggtttcacttctgatagacagaatgagcacaggttttgatttcttcttcttcgtggacctgactgaattaattatgaatcacccaacccaaatcagtatccctacttgtcggagtcgaagaaaataccattgttcttgcgcatgtcttccatagcaattagaatgtcaagactcaagtctcttaggcgggcttcggcctttttgtctccctcttgaataattcgtccaaattcccttgcctcccaggtcaggttgagcaaactgctgtactctggcgttgcgtttgcaaattcttcacctgtggtctgaccgtgcgggatgaattcaatcgtgttaatctccgtgatgctagacacgccattgatccgaatggtgcccttctcacagtagatctctgtaggtgtatgtgacacgtagagtttactggattgtgcgtgcacgacaaacttctgtttgtgcttggagctttctgcggtatactggaagataatattgccgccgccatcgacccctgtgcgaatgattacggggaaataagtttgacttgccggtgtgccgaagagagcaaagataaaagcgacagaatagcatcccacatcccacaagcatccaccgctgaacttgggaagaacgatattggcctctttgccatcctcgggcgtttttgcgtactctgggttgtagacggctaacgatatattggcgccatagatcctcccgaatttgtcttcccttgctttttcgtcgtcgagaagactttgaagcttcagaaagttgggctcttggatgtgacgccaggcctcaataacgcataatcccttcgcgtcggcaagcttgtataggcccctgacttcgtcggcgttagaaacaaagggcttctctacaatgatatgcttgccggctgttagactcttgatgccatgctcgtagtggagcgaattcggtgatgcaatgtacacaacgccaacctcagagtcagtcagcatcttatctagactatcatatgccctgacggacgaaatgtccttgatagagggcgtctgtgagatgaacctggtagccgaatcaatgctacgtgagtatacagccttcagctggaactttgtgctttcatgactggattgcacaaacgagttgctgatccagtttgtgccgattatagcaagtcctaggggagctgacatattgagaagcgggatcaaagattcaagaatgtgaaagatagatgatgggtattgctaatagatactgtatgatgttgcgctttattcgtcccatgcaaagagggggcctcagctctttttaaacaaaggagaagccctgtgacaagcacggcctgagaggacctgtttcatcggggattaggtccttctggtcgttgtttgaggaaatttcagccgacacataatttactattctagttattgtcgccggcactagaccatctgcgatgtaaatcaaccctaactagaaataatatgtgggaattgtcctcctgcaggcccattctctcggtcggtaagttcgtcatcatacgaaggcggctcgaccatttgtggtcgaatcgccctccaagtttgcactgaattccggccaagaagggattttagtcctatatcattgcgtttctaaaataataaaactggttcaaatccaaggcatagccgaatgagacaggtgtccctcattgctattgaggaggactcattttgacaacagcctgtaatatggcaatggtctcatatcaatctatatcttctgcttcatcgcagttaatccaacagccctggcgcttgtctgggccacctgtagtgtcgagggattgtgtatctctagctgggacattggctatagaagtcagaatttgtcgccaatatcttctccctccagattcgcattcttgcatttgcggtgatgcttggccctggcattcgccgaggacatttctcaacgtacggtagccggtgagatcccaatccactgtcacctctgctgtgggtggtgctattctttccaaaaagctatcgatcctttgtagcgtgacagacacgtttgctgggattgattgacgccactgttcggggttaaaggttgcatggtgattcaacccattaagcaactgattcctcttaatacaaatatctaggtcccaagtaacgggggatatacggagatatagaagacttggaaatatgggtgctgcgtgaaggctgggcgaggagatttccggatcttcaaatgcgtacttgaaaggcgatctttgcgtatcgatcgccagttctagggatctaatcgatctgcggatgttgggaggtagtatgctcggagaggaaagcatgatatcggacgacgacaagtttatggtgttttctctatagatcacctccatgccttcgatgtatctagatacattgtcatatttcagtcagttctcaatctattgagggatcaaagagctcaacaaccacttacgcttgtctagatgttaacagccaacctaagcattccagtcgacatttatcaggcttattcccgggccaggcgtggcaaactccgccccttattagacaggctgacaacctatattttcgattgtctatgccaggagagctgcgaaacctccctagagatagtgccatgtcttctggaccagagcgatgacagacgcagccataccaccgccattgccactcgtcctcgtcgtacatcctagcataatgatcgagccgtcccaccagtccggcatgtgtcttcgcagctaatgcgccaactgaacctccctcgttgggcttagtcgtcaatgtgtaggagagatcaatatggacagtgcgttcgccaaaggcgtagaccagaattcgacgtcgaatctcgaggggcaggcagccaaagaacttgtccttcgacccaggctgtgatgcatcacttcgaagccgagctagatcaagagtggaggacggagcaacgtgctttgaaagtgcttcttggcgtcgctttatgaaccgcatatatctgtttgtctcagatttaggatgcacatactcccgaaatcggactatgaattcgaatgtgtacatgagtgaatagagaggaatgcgaaagagaaggccgtatagaataaatggaagcaagaacaaaaggtactgaaggaaccctatctctcggaataagagtataaggtcccgaaatcttgggtaccctctgtgttgactagtcatctctgttgacctctgggtaggcactcattgagtgcggcggagaacgacgatgctgtagctaaacagtcggtgatttcagtgagcccagatgcggggtcttcactctttaaatacaattgacgaggaaactggggtctcgggtccttcagaaagtcctagaaaggcgcggggggtttcggttgttacgccttggacaagagatcttttgtcgaggaggaacgtctggaataggcaactggacaaaggccggttgcataattctacgattgatcaaactagtgacctccttttttaatttacattgcctgtttcttacggctgtttgacatgctgttggaccggtagaaggatcacacaggaacgtttcgcaatcggcgccatatcacacactggccatttccgcgtttccaagatactttgtaatgggctaccatattttcaagataattacttttaatagacagaaattgataaattgaagtattgctcattccacttaggccgacggcagcaccacttttgacttgctcatcatcttcgacaaaccgcggtctctcgaagtacgcattaatccagtcatctctatcttgccacataaaacgttattatatatatgattgtgcgctcccctctacgcaatatccttttttcacacaagttactatcgtaatgtccactcttgacgcgggcaagggtaagactagaaacaagccgctagtgacaatatacgcagttttccgggaatccgacccaaacgaagctgacgtactcgaagtgacatgctattttgaagagagctccagtggagtttccgataaattataaaaacaagaattccccagcgcccattccctagaatttgaccttagccggtttctaatctcaccacactggccgcaaacataatccccttcaattttctacaggctttcattgtcacctgacacctttactttcagcttgctgaggattacttgctgcctgttgtagttatactcgttgagcaagctagctagagtacttgcattctctttcccccctatttcgcacagcatgatggatgtctctcggagtaccacgacagtcctggtaactgggtcagccacataaacattgcgaatgcccaaatgccttgcaggcactgattcctgtctaggtgcactcccggaggcatcgggtatgaattatgcaagagttttcagcttcgaggtatagtctcatacccatcttcttaaattgctcaatggacctcttctcattcactgtaaaggatgcaccgtcattgccacagctcgtcgaccagaagttcttcaggagctcgcagggtcgggcatgatcgtcttaccgctcgatgttacggattcaaatagcattcccgattgcaaaaagcaagtagaggaaattaccggaggccgcctcgacatcttggtaaataacgcgtgagttctgagatgagttttggcgcttctcttgatatcgcatgtccaactaatctagtctttaccatagcggcgtctcacacactattccggccgccgacatcgatatggatgatgtccgtaagaccttcgaaacaaacgtctttggcgtcatggcgatgacacaggcatttcttgatctccttattcctgcaaaaggtattgtcgtcaacatgagcagtctcgcatccataaccccatacgtatatggttcggtattttgcgctacaaagggggccatcaattcctactctcgaacattgagacaagaagtacggccttttggtgtccgcgtcatggtcgtgatgactgggttcataaagacgacgagtggcaccaaagtctaccgggaactgccagaaaactcaatctacaaggtggttgaagacgcgtatctcaggaagcttcggtactctgagaatacttcgaagatgagtgcgcaggacttttccgctcagctggtgggaagaattcttgaagacaagagctggttttggcccatttttgggccgaagaatgactggatctggctggggggtagtgcctcgctggcgaggtgggcgacctggatcggcgaatgggtattggacacggtgctctatcgaaggtttggcctggatgtactggagaggatagtagtgcaaagacggttgaattagatacggcaacttgatcaggctgagaaggactgttaataatgagagataggcagtgactatcacatggttctatacttgaagacctgtgctagtgatgtcgatcatttttcatctgtctgagcggcggtagaaagttttgccacggcatattcggcagccgcagatgatttctcaacactttccccacagcggcaaaacatatgccagctcactcgccatgattcagttgtaagcaatttcacactgctcgcgtttaacccggattcaaagtccctttcgtgtaatggtgattataacttgctgcatctcaaaactccgcccccgaacaaatccctctctagtagccgagtctgacaaggatataagccggagcacaggagtgatccaatgcgccttctcacctccaccatcaaacctctcggatctcaccgcgcctacagcaccatgtcttctacaaagccttttatcctcttcttcaaccctgttagacatgccaagtctttttatcaaagtctccaagaggttgcacatactgaagtcgtcacgagcaagaccagggatgagttcttcaaagaccttgaggggaaatacagggaaatttctgtcatttacagaacctctgctagcggtgctgtagccggcaagttcgacgaggaattcatccagcgcctccctgcgagctgcaagcacatctgccacaacggcgccgggtatgatcagattgacccggctgcttgttccaagcggggtatcatccttacctatgcgcctgatcctgtcaccgaggccacggctgacctggccatctggctcctattgggtgctctccggcaactcaacccgtctctgtcctcgctcagggctggcaacttcaagaagggcattgactttggccacgatccgcaggggaaaatcctgggcattctgggaatgggccggattggccgagctatcaagaagcgcagtgaaccgtttggtctagccacgcggtatcacaatcggcgccccttgtccgaggaggaggctgccggcgctgagtacgtatcatttgaaaaacttttgaccgagagcgatatcatcaccatcaacgtacccctcaacgtcaccacgaagcatctgattggggcaaaagagatttcacagatgaaggatggggtagtcattgtcaacaccgcccggggtgccattatcgatgaagccgctatggctgatgggcttgagagcgggaagattggcgctgtcggcatcgatgtttacgagcacgagcctgagattaatgagaaactactcaagcagagcagagctcttttggtgccgcacctgggaacacatacaaccgaaacactagcgaagatggaaacatgggccatggagaacgctagaagggcagttctgggcatcgagctgttgtcccctgtacccgagcatgtcaatacgcagtcctagtagattcacgacaaatccaacagaaatgaaacggaaattttcggtgtgaacccctagaagatctggccttaaacaagaccatgttgagaaattttgtggtaacggcattgaagaacgaacgaaaactcatgaaaagaaatggaaatattctccgatccaacattacaagtcacaatagcccaaatatcctgaatccatgatccaaagtagcgcctattaccacttgtagtaaaatcaccattggcaatcttttgtggttatggccgtggctagattctctttcgcattccgaataagttaaattttactacagccagtaatgttggttgttatagaagaggaaatattatccatagtcgtgcatcatagttatcagccatcaagtgatctttgaaggccctttccctcttacagccatatacgtaactaggaagaaactcaaagtaattaattgtttacccgagattagaggtaatgcgttgaatccttgtaggaaacccgtccgcagtttggacgacgaggtggttaaaactttagccgcaaccttttaccgaccggcgtcgaaggtcgagcggtgcctgggacgtcacttaccccagattacgaattgtgcatacctactggaaatctctttctttcaaccatataaaaggctagacaaagccaaatggagaccaattgacaccgggaagaatatagctggcccatactcactctgacagcacgcctcagctaaaatgactaagatcgctctccttggtgctgcaggccagattggcacaccactcagccttttgtgcaagtctgtaagtctttaataatcttcaaactagtcatctttctgaaggctcacaaagtcgtctacagagtgacttattcaatgaaatctctctctatgatattatccatgccccaggtatcgcgacagacttgaaccatatagatacgagggccaaggtctccggtcaccttgctgaggatggagggctacagaaggcactgcaaggggctgatcttgtggtggttaccgccggcattgcccgcaaaccagggatgactcgagatggtatgatatatcgccctgcagctcggcctagctagtagctactgcctgtattacacatgataacacgagataacattgctggcttcatagatctctttaaggttggcaactatctttcttttcttacatatggtcacactacttaccggctcacctctgcgctagactaatgcatccatcatccgcgacctcttcaccgaagttgccaacacttgcccacaagccatttgctgtatagtgacgaacccggtcaactcaacagtccccgtggcggccgaagctttacgtcagggaggtgcatatgaccctgcccgtctgtttggcgtgaccacccttgatgttgtacgggcatcgaccttcatcgcacatgctctcggcggaggtgcagaccccaagtcattcaaggtgcccgtcgttgggggacacagcggggcgaccatcttgcctctctacagccaggcagtgcctaaaatcagcatcgactcggcaaaattggcacaagttatccacagtgagttcttgttgcctagaatttcgaagtactgtgattgataactaatgacctttccactttacgcaggggtacagtttggtggggatgagattgtcgagagtaagaaaggcgccggtagtgcaacgacctgcatggcttacgccggatttcgctttatcaaggccttgctacaagcgaagggcggcactcctgttgtagaggaagcctatgtctaccttcccggcatccatggcggtgaggaaattgccgccaggctaggagtggattactttgctgtgaaagtagagctaggtcctgatggagctaccaaggtctttgatattggctcactgtcagacagtgaggagaagctgctagaggtggctctcaaggacctcaaagcaaatatccaggctggatatgctttcatgggtgtgtaaattatgtataaattcaatgaagcacacatttcaggctacatccacacaagctagaattctaatgtaaacataatggggacagctaaattctttaaaggggtggttgttggagatacatacatcacacctaaaaggatattcgtggcatatctaggaagtagtcaagccgcgacatagcatggagttgaaacacctggcagtgcgatccggcaagtatccattggaaaccttctaccatccccctgtgccaatgtcactatccagtctcacctctttccatgtacttggtcccacgagcatcgaaaacaacccggtctctaaccactctctcaatgccaaacttagcgaaagatttcagtgtcggatctatgagctataattggtttatcctggcctcaaattcccactgtcgtaaccgccatcatagtctcttggtagatcagataattcgaaaaccggtctggaccattgctgagttcattgtgacacattgcggcgacgttttcgattgactgtaggcaagagttgtatagatgctcggcagctctgtcgtgtgcaaaggtactatacagcaaagactagctcacaagataagcagatgacgtcgagaatcatgatcttttatcactggatatgaggcgcagtgattattggcctgcgctagaaaacggctcacgtcgtcattgactaaagctgcgacttctttctgcttaggctgttgcacgataatgcagaatagcttgaggcatacggaaagggggggaacacatcgaattaggtctatttatttacttggagctgattgattcatttgggccattactttagctattgagtccaagacggtcgtgtgaaactgatcattcaatacggtggcttcgtggtgctgatcgatcgcctataacgggcgctaaaaccattgtcagtgactgcattcggctgggcgtttgttacgttgtttacgggacagaccgggtgcgtcactccgctgccggacagttcttcaatggttcaattttagttcaattacggctacaaaggactggacagcgcttgcggaacgttacgtaacgctctgggatagccggaacaatgaatttctggcggcttcatccttgaaccattgactttcatctccatcagaccgcttggcgccaagatcacatccaagatagtatccaaacaccaccagcaacaatgaacaagacttcacgcaccgaggagccgtacgagcaagacacgcgcggcttcaaccagaaccctgcctcgctctcggccgacctgaccacaaatcaagatctcaatggcattgtcaatgagcgggagcaagcatcggacaagcgcagtccctccccgtccgaaccgccaatacaacatggcatacagcatgagccgactctcaggaggccttccaagaccttggcgggacccaagcaggctggcgaggtcgccgcagtcagcctgctcgatgggagggacacggcccagcccgccagctacatgtccatcccgataccgcctcctcctcgcggcagggagggaggcgacggagagggcgattctcccaactggagacgccagctcaagaaggccgtcgtcaaattcggctcctttgtcggtcccgggtttatgatttccgttgcttatagtatgagacatagatcagcatctatttcatctcttttcttgatgctaatgctcgacctctctagttgacccagggaactactctaccggtgtggcggccggggctacattcgagtacaggctgctatttgtcgttctcatggccaatctctttgccatctttctccagacactgtgcatcaagctaggtacagtctcaggactcaatctcgcccagtgctgccgccttttccttcctccgtggatgaactacatcttgtacttctttgctgaggctgccattattgcgaccgatatcgccgaggtatgtgaaccctgtagatactacttgggagggtattgatactcaacaaatgcaggtcatcggatttgccattggcttgaacctcctgataccagcgatacccctcgttgccggttgcgccatttccattatcgacgtcatgcttctacttctgttctacaacccgcatgggacaatgagaggtctaaggttgttcgagcttttcattacgttccttgtactaggtgtcgtcgtctgcttttgcatccagctctcccttatcaagcacaccaacatcgggaccgtcttccgtggctttttgccctccgacgccattcgccagtcagaagggtaagtgtgacaaagcgattatggaaaaggccacctgtcgatatctaactcagactagactgtaccaagcctgtggcattctcggtgcaaccgtcatgccacacagcttatatcttggctccggtatcgtccagccacgcctgagagagtacgacgagagccacggtcttgcgcccgagactcgcgacaatattgacgattcaagcgaagacggcaaagactattatatcccctcgctccaggccatcaaacactgctaccggttctctgccatcgagctggcaatctcgctctttacatttgccctctttgtcaactcggccatcgtcattgtatctggagcttccctcttcgacaaccctgccgctccggaagctgacattttcggtatccacgacctcctatcgcgatccatctcccccgctgccggcactatctttgccttgtctctcctgctgtcaggtgtgtccgccggtatcgtatgcacaatctctgggcagatggtctccgaaggggccctacgttggaaggtgcgcccatggctgcgccgactcatcacccgcagcatcagcatcgtccccagcgtcgtcatcgccgccgccgtgggccggtcaggcctcaacgatgcgctcaatgcgtcgcaggtggtgctcagcatcgtgctcccgtttgtgaccgcgccgctgatttacttcacttctcgtgttaggtacatgaccatcgctcctggctcggaccgatcgggcggtgttgccactacgagtgaggctattagtgctcgggaggcgggaagcacctccatggaaaattcttggtacacaactacattcggcatcttgctttggatcactatggcagtgctgaacgtcgccaatcttgtcttgctcggtctcggcaaatagactagcttctggcacaaggggtcgatggccagctcctaaggcaagcttccgaggtgagacgtggcatgcttccaatgccggcgcaggcacatggcccagctcaagattgaaaccaatatactgtccttgcgtcactttctgttttggtcgtcatgccaatcttgcttccttctttaaactactcgggcaactgtctgctactgaactgttcatgttcagattgatgagattcgggggtataggttaggtcagtattctacctaccctgtagctacttgacacgagcagccagaggctccagccataagtagactcccctagctagttgtagcctcaagatacgctcttctaccttaaatgagtcaattcactcaaaatctcgccattttttaaatcctcgattaagaaaggttatctcccccgagggagaacctagctatggatctggaagactcagccttggcagcatctttttaaagccacaataatttcgcggggagacataattaacaatgcctgtagtctcgtatgctcaaaacaataaaagggcatgaacaatgctcgtagtgaagacctcaagtatgacggcgtaagtatcacatgtcggcgaaatagttgacgccgaggggggaaggaagggcagaggtggtggtgagttcggcctgagctcgcggtgaaatcatggttgttaaaaataaaaaataaaaacgcaaaaaaagaatgcttctgctcggattcgaaccgaggtcgtctcctgtggccccgtgatacttccttttgggaagcacacagggaaaccgcacaattggagggcgcgaccactgcgctacagagccagttgtcgaatgacagtaggattgccgggggaacttgtatataaggtattaccctcggcgcgttggctgggactgttctgatcggtggcgaaccttgtaggtcgaggaaaggttgcttgaacgccaacagctgtcaacacaagtcagaagagcagggtccggggcttttaggcagcaccaggtgccttacaaatagcggtgctattacctgtataatctgtcgtatatggtgttttcttcggtctattttcacgtttggagtgaaaataacttaactaaatatatatacgaacatgaagtcggccaggacggaagagaatttgagtataaagttaaacagtaataaaagatactagatataatgacttaatatagtaaataacaaagattaaaagaagttttactagtctaatgctatagttatacagaaaacaagtctataatccttcataccgatgactcacttaccgtctggacgcgctgctcgtaaaatgactattgataccctctttcacctggcttatcagggtccgatagaggatagcgtcaataaagaagcctttcaacctttaaaacacaatagaaacaacacagtgagggaagtcggccaggacaacgacaaccatgacgtaagagaaagacaataaagttcaatagcaatggaagctgccagagcccgacaactcaacacaacgaatgcgaagacaaccatgacacttttcacaccgtctctccagagtcaaagaaaccgatcattgtttattcttcttctcataatttcatcaatttcacctcttctccttaccattatttttgataaacagatgatgagagattggctccctgccctccctcaacacaacatcgcgttctgaaataccaagggtccctaacctctactgggcgggttgctccgatccttctcctgtacatccattactattcctagatcctatcgcactaccttcagttgggatgtattcatctttttcgtagcgtaaccctcacgggcaacccatccgcagggtgtgcaccgcctccacccttttcagcttggtacgctctgtttccgttgatcgtcttgttgccccgtcttggatgcctcacatcccattcctcataggcgggagtgatgcaaaactctcgaagtgtcatgacgagacaaatcttcagttcaagtatcgcgagcggctgtcccaggcaattcttaggaccatgctggaatggtatccatgcccctttaacggggtgtagaggatcctcagggccgacaagccatctatcagggttgaaatcctcgggatcggcccagtacttgggattatggtggatggccaatgtcagcgaccacacgttacacccttcggtagggtaaacacgaccctgctcatcaatgacgtcggcacctggtcgcccttcgcgcattgaagcagcaggagggaagatgcgcagcacctcttttatcactgccaacgtgtatggaagctgattgagccggtttggattttcgcaaatcaagtcatgctctcgagacgccgtcccgtcaccaaagacgctgtcgtgctcggccattactttctccaatacgtcgggatgcgcagagaggaggtagtagcaatatagaagagtgctgctagttgtatcgtggcccccgaataagtaggcacgtagctgggccgtcattgttttcttcaacgattctttatacgtatccagatttttgactccttcgtcctgctgcatcatatcgtccagaagcaatgatattgtcgacggatagcgttgtgtgtccagatctttgtcgatctgtgtattaagacattcttgaaacctcttctcaatctctacggcgatgtatttatctatgcgacgcccattgatccagtgaacgagagggcggagggagagataccgctgcagtgggttcatggcggtgaatgtggtccattcaatctgcctccgcatagctctcgccagctcattgttcgtggtttggcagtgcaacttggtgccactggtgaatacttagcagatgaaccaggataggatgaacagacacgcgttatacatacaaggtaacaactccgataacgtcgaaagtcaatctcaaagtcaactcttccagctggaatacgtcagaggtccctgctgagcatcggtcgaggaggaggagccggaaagctgcaacctcttctgccactgctggtgtgagagccatcatgctgcttgcgctgaacccagagctcagagctcgacgctgtctcttccattgtgggccgattcgcatcgtcaataagctcggcccgccggtaatggtctcgattggatgaacgatcgaatcaggcaccgccagatcaaatgcttcaacttgggcggctccggatggcgttgtgatgaccaaggtggtcctagcaaatggccagaggtcaatatagaagaaaccatggggaaattgtttcgagatttcccagaagacgttgtgcatgacggtgttggacgggaacgactctgagatggtttttatggtcagaagatggcccgtcagcggtttcacattgggcataggctgtcgatgtagattagcgacaccgaataatcactctgcggatgaactctctcatctgcggaatagatcaactgaccaagcctgcccgttgcaacttccatatcaactgccgcgccgctgacagtttaacgaagaaaacgaggagggctggaactcccagtgtgaggaatatggtagaaagccctgccatatctgaaacctttggagcttgcgctaactggccacatccgccgttgaatgtagctccaagatatttgatcactgctgacgcgtgagaaagatgacatttttgtgagctacgttgttttttaaagatgataaacgctaccctctgattggctcggccttgctgactacaagtcttcagggggtatacattgaggctgtacatttgtatagaacggatagcgtctgcccgaggtactagaagggctgcatcacatgaattgatagtatgaagctacctctttaatcggcagatcctcccctcccccagaaccgtgtatctaacaacaagcggctagcccagcctcttctctatttcaacaacatcggtcttgccgtccttggtcttctcctccagggtgtcattcttgccatcgaagatttccgcgacttgctctaaggaacgccccttggtttccgggaacaagaagtagatgactacgaacagcactgaaagaatacagcaaaagacgatgtaaaacttccagccgatggccttcattgccactggattgacgagctggctgatgatcagtccaatgaaggtcgatgcgtacgtcaccgtaacaccacgagcgcgcagtcggtagtcaaagatctcaactgggtatgccagaaggaggggtgcccaagcaatatcgtagaagaaatagtagatgaagataaaggccacgacggcgtttcctgcagtggtgttgagtgtggccgtgaagtatgccgtgagcgccgtccagatgatatagcagacaagcatgccagccaccgatgtgaggaacagcgtgcggcgaccaagtctgtcaatcatgagagcgccagcaaaaacggcggcaagccagttgaagacttgcagcaggccattgatgagggtctgatccgaggttttggtgatgccgatggtgttgagcacgagcgtgagataatatgacacaacggccgcgccgttccactgggcaaagaagccgacaatggccgcgatgagtgttcgtttccggtttgctggtgtacggataaggtcgagataactcgtctctgactgtacggcagcctgctgctggatgctctgctcgatctgctcgatctcgtaatcgaccagaggggactcctggtcgccacctgcatgccaacggaccaagatgtcacgagcttggctctgtttgccatttgcaacaagccatctggtagaatagggttagagatgaatgcttggtagggccaggccatattaccttggagactcagggacacaaataaagaacaggagctgtagaagtggaagaaaggcctgcagaagagagggaatcctccaactccaggagttgtccagacggaaggttccataagttgaccacgcggcgaagatagcgcccacgtactagggagcagaacattgtgagttagccaacagaagctgagacaagaaagaaccaaaatagagcccgcgccacctacaaagaaggtctggtacattcccgtcgctttggctcggtgagtagggtatgcaagctctgcgaccagaatcggggcaggttgtgcgacgagagctgtagcggcgccgaggatgagtcgggagacgaggaacatggcgagattggcacttcccgcctgcagtccagcagcgcctatcaggaagaagagcccaatccacatggacaatttcctcccgtatcgatcgcatatccacgtcgccgggaataggccgagaactttgccgacggggaagatggcgttcatcgccccgagaagcggtgccgaagggttatcgaagtacgcacgccattgaccaagtgtctgaagtccgttcatcatagcgcctgtggatttatcagttagattttgatcgcgttcgggcacatcgtaaggggttgacttgccatcgaagccgatactggcggcggacaacagaggtaccaacaaggttaggttcaggagaacgagatgcttagttcgataccatggctttgcatcagctggcagcatctatatagcaacgaggttaatgagtacaattccattgttttggttgattagggatctgcgcgactcacagctgccaactcagctccaacagccaactccgtctcggtcttagcgcccattgtcggaataggttgaggaagaagcttcaatctgaagggagtcggaggatatagaatggtagacagggttggtgagggtagaacacaagattgtgctccgggagggccctgtagatatactcccacgcccggagaaaacttggtgatatcgctccccttcccccattccggggtctccgcatcagtccccgcaggcaatcaggcaaaaaggaaaacagggttcgcattactcaggtgacactagccagagactagcagaacaatagaacaaaaactaaagctccacctcttgagcaggttggcgagaatgatcataagtctgtattcagtggtctggatgtctggacttgtccagatctttctttgtccttgagcctaaaacaccgagagaacaagatttatttcgtccctgcactgctgatattatgtctccattggcgaagtgaccccggcttgcgaaccaccgggagctcccgagtacaacatttctgttccgaccccggaacgacgtccggaacgacccccgaatcgcggtgcctcgaacgcctggtggacttgtgcaagcgccgcctgtcattcgtgccgggccagaaagaccagatgtgataaagagcagcctacctgcgggtatttccaaaaggactggtctcaaatgcttttaccctgacgacggccaaggacgactatcgttgtgagtgctcctgggtggaactggacccgggttcagtaacctacactatcttcccaagcattcaccacgtgacagcttcaagggacggaggctttcacgcaggtctcaccctctttgacggcaattcgttctaatctcgggcttacagctgccaaggagttgggcctcgactgcttgacagcatcgagacttgggcggatttgatacgacagaacgaaagaaaattcacacaagtcccgcaaactgggtgtataacacttccagtaagatctggggtcccgagcaactggatgatgagcaccggcagttcaccaatgacccactgcaagctgatcaagatcagtgtccggatcgagttcatcgtatccagtgccgcgggtctagactcggtgctaagatgggcaatctttctaaaaccgatctcgtttatggcgagccctgtcttctcagtcgcgcgattactgcggccggggccaacctctctgcaaagcatggagttctccgaaatgaaaaggctagctagcaaattcctaaccctcgcacatccacagaatcccgttgtggacacacaggccctccacctgctcatccggcaggtcctattcaacctgcctcgttaccctcgtatgtgctctatgggctttgtcgacaaaacataactctggggcggagggagcgaccagtccaaatgagcacgataagatggagacggttcttgcctcaatactggaacaacgccgagaggagagtaagttttacgatggcgccaaccagtagccatttggaaggcgctcagtgtatttgtttagccgggtatgtctattgatctttacaattgaccatgtattggtgaataggaaatgtttttactcgatagaacagctgcggaacacataggtcgacctgccctgcaagcgtttcactagtaaccgaaaggagatcttgcattgaaggcttatgggtcgagatctctccagttaactttgaaattagcctaaataatgaaaatgtttaaccgctgacttcaatagttgttgtgcactgcctgggatatgtcacttctgtctcgccgatgctagctttccagcggggaggccatagaaaagggatgagctccccgaaaacagaccaacccgccaatcacacatccgtggagactccatgtttcggggaatcccccggcacaaagtagcatttgcccggaagcctccccgaacattgccccaaaagcgtgcctgcatagaaatgatcactgctacaacttcaaacacggtgattattatggctgctagtctcggagaatcaatggtgtcatccatgtgcagcctagcacgcaagatcatttgtgaaatggatcaagtacggctgtcgggtgagactgaccatggctctcttattattggaattattatcaccgctaagtaaacaaatacacaaatgaattattccttttaagtttaaaggtaaatgtgcaaattacgttaattcagcctcaggtcttatagcgttctaaggagatttccatcacgttcttaccttggtcagcacagaggcatataatctttattgcccaattctgtctacctaacctatactgttagaacgtatcatgagagattaataggtttatgtgtattctccgttatctgctgcttctccgggccatctcggacgaccttttatctcaatctcaagctctctgcatctcacccttgattgactggtttgatcatgtaacccttaggaacgagacgcatttgtgcatttagcccgcgtatgttggcaatcgctctgaattccaggatgctcagtttaacatataccagggaaactagcaggtttagtatacatgtatagtggatcctgttttgctagaaatcatcatagtcatcacgctgagggtctaccgatgacctcaaatgatgagagcccggtcgggcccagctgcaggcactgggtatgtagtcagccaaagccccgaaggccgaaggccgatcacaagtgcaacgaaggccgaagcacaggccgagtcatcggacacgcaacagcgtatgactcttgatcctaatgtctatgcatcacttttaatttttcatttagctgtttcatttcattcaggtcatcgaatcttgtttgatatagcaatcattaggtcatccaatatctatggtaacgaggccgttttgttttctgcccatccacgctcacgccttttttttttcaacaaccttcgactcaaaggccaccccgaccagactggctgcagcagtattctagaaaatactttctgggtggtgcttaccctatctaactaactccaaccactggtgtattcacaagccctccgattgtcgaagaaacgaagactaaactcaccaccgccaacatggcagccatggtacgcatgcccttcatctcctatcgtaacccagacagaagcctgcaaggctatccctcttccgattctcgtgcacgcgatcatgcgacgtgcttgatcacatgcaggactcgcatgcaatcatcctcattcacctgcggctgttaagaaaactctttgattctacgttctaacatctcagttgcaggatctccgagtcggcaataaatatagaattggtcggaagattggctctgggtcattcggcgaggtttatatcggtacaaacattatttcaggcgaggaaatcgccatcaagctggagagcgtgaaggccagacatccccaactcgagtacgaagcccgagtctataagtcccttgctggtggggtcggaatcccatttgttcgctggtacggcactgaatgcgattataatgctatggtctacgatcttctggggcctagtttggaggacttattcaacttctgcaaccggaagttctctatgaagactgcccttcttctgatggaccaactcctctctcggatagaatatatccacgccaagtccttcatccaccgtgatgttaaaccggataacttcctaatggggattggaaaacgagggaatcaggtcaacgtcattgacttcgggctggctaaaaaatatcgcgacccgaaaacccatttccatatcccctatcgcgagaataagaacctgactggcactgctcgctatgcctctatcaacacgcaccttggcgtcgaacagtctcgacgcgacgacatggaatctcttggttatgtggtgctatacttcctccgcggctcgttaccttggcagggcctgaaggccgcgagtaagaagcaaaaatacgatcgcatcatggagaagaagatgacgacgccaactgaaaccctctgccgcggcctccccaacgaatttgccatctatctcaactacactcgatctcttcgattcgatgataagcctgactatagttatctgcggaagctctttcgggatctcttcgtccgcgaaggcttccaatacgactatgtgtttgattggactgtttacaagtatcagaagaacgccgaggctatggcgaatgctgctggtggcacggccaatgacggtgtggccggtggtactcaggtggtccgcggcagtcgtactcgcaatgcgatcacccgcactggtatggacgctcgagagaccggccgcgacagagtttgagtcccataccggttcagatcacagtttagcttgcatgaaatcgccttgggacttcttccatactcttcctcacactgcccaaaagtccccatcagctcgatgaagaatactgctcaagcggccttgcgacattattcatgccacagaagccaggatacaaccaccaacggggaatttctaacctaggatatgtggcgaataaaagtgaagcactcaaggtggagcggaatatcactagagatgagatattgctacattcaaattcgagagcacttttcacatacgggatcgttaggttatcggaggctatgggtggtattcacgagctgacttgtgctcgctacgttgaacaaacacaggggcacattgctgaggcctgatccaagccaggggcttcatgcacgagtatttacctgttctcgtacttatatagcgtagccttcagttatggcggtcgtttcagctgtgtaatggcaacatccttatttctactcgctgcatggggccaaaacctatagatggcactcctgaaaagccctacgagaggaataacgcagaaaatcaattcataattactacatataatagctcccccggacgtctcaggttcaaagtctctatggtttaagctccaatctcccagtgtagtaggttaagttaaggctaatagcgggcgatatgcaaattccttcatatcgcatttgggaaagcgtggccgacggtgccgtgatcctaaaactaattatgctattttacgccgtttagtcgatcacttcacttagactagcccccgtatcatctatcaaaacttcatccagatcctcgtagagatatcccgcggaatagtctgtgggccacgatagctgcgtttcagagttcgccaaagcccaaatttcgggcattgatgagtcgctcggactaggctctgcctcggtcctctcctgtgcgtaaagagaatgattcgcctcacgcctcttctttgctgtcctcatcaactttataagagatttccacaattcatccgcgtgctgggaggtagggaatgaaccccagcagtccaatgcaagctcaatagctttccacgccctttgagcgatttctgtcttgttggaccgaaggcacagctcttccaaaatgatcgcgattgcgtgccaatggatggatgtgcggaaaagcctgctccagcgcagcgatgccgatattgcgacgaccgcataagagcactctaacgtctcgatcgacgctgtcaataagcggtctctgacggcaggcgataaagtagatcttgcatcggaagacaaaacggggtggtgaaaaagcagcggtaccttggcaaagaagagtcgtgtatttagagccgtcaaccactggaaatactcgtcatcgacgcagttgtgcaagtacttctcctctacgttcttcttgtaggtgattgcaatgcgctccatctcatcccaatcaggttctgatgaaggtcgtatgccctcgctttcacgttcgagtcgtggcagtttcttcagcaacgatccaatctcgtgcttgaccaacgttggtgccatgtcagtcatgccggttctcgacaacgggtattcgacgctcgcagggccaaggtcagagtcattgatgtttagcgggagcgccgcatccgggacatcatctggtattaaccaatctgttccttgatccagggcggtccttaaatctaggagccagacgctgagccaaagtctgaggctaatctccgtatcgtatggaggcagcttgttatctcggcgaactcgatggatcccaatgccttgcgctattcgcacggcgagcgcggtcatagtccaagtgaatcgtgactgttcacgctctctcaagcagaagagaaacaagacgaatgcctgtagtgtcatcaggtccgaagatgacatgaactcagccttggcgagggccttctctgtagccaggcgatacttcgcagccagggtctctttgtcctcgtccagaagctcttgtacctattatatgttaagctgtgccagtggacgaatactaggcgtacctacttcatttggtgtcatggataccaccgcggcaaagtacattgcgaacatgaacgcctccttggatgggcttaagaatcgaatgctacgctgcatctctctgatcagtttgttcatggatggaatgtggaagatcttgattagaggttcgacattctctacaaatgtttgccagtagaagggtatctgtgatggagaaggatgcatggctctagggttgacatcaggtaggttgtaaccgattataaaggcgtaatgatcggggttggccgccgtggtctgcacgggacagtccaccaagttggcgctgttatagtctgaagcgctttccatctcttcatccacactctcaactagaatgacgccctgtggttctacgagctacaagcagtcatcagaacaaacggaaaagagcaaaggggatgcgcaaacgcaagagcaatcactggaactgagatctaccacgtaccagttctgtcagcctcgtcaagtctggagcataaacatgatcgccgtggtcagtcgtagaaggatctaggagtccctcaatctgacaaagagatctcgacagcccttctccaaaatacaagcatcgctctatccactgttctctacccagtacactctcgttggagcttccgaactgatgatgtattgcgattgacgtatcgctagtcctagtacctggcactcgatcgaggcttgtctgccctccaagcgtctccggtttgtcgtcctgggaaggtagaacctgtggcgagtgctgcgcgccttgtctgaggaaattcaggtccccgatattgagaggcaccccagggtctatcggccaagactggtcggttctggaacgctgaccacgtggtgtcggccgagcccgtccaggcggggggaaaatgcatgcaactccatttctgttgcagttggagcatggtgtttccttgttgcatctgacctttcttcgccggcatgtgatgcaggatcgcaggcttccccttggaccgttggactgggtttcaaaggatcgcgggtgcggcaaaaggttgctggggctgaaacctgggttacgggaaaggtctggatttgaaggaagcgatgccattctaatcccaagattgcctggtcgtgtagacgattgcaactgccgcctgctattgaagtctgaagaagcggtggataaagaccagcattgattgatatgttgcgtaatcacgtgagcgcaggacctttgccagtacatacccggcctacagtgcttgaataaaaataacataagagaacaaaacgtagaggcctgtctttaaaatccttcattcgaaacctaaataactatctcagaactagagatgatttaattaagaaatattacatagattcttgaaagctaaaaatatatggttatctgaaactttgataactaactatacttaattcaaacatattattgcaaataatatttcccacctatttataaaataaactagtctataagacactttcgtattgtaccaagcagcgctactgtcctctgcgtaaacgatgtccgatttgtccgagataataattgtaagcccgtcaggggtctgtagccattcctgtgcactacgggtgaatttccaagatattctaggtgagctctctccgataccaaatggcttgctatgacactcgaaagtgaccttgcagacgaatactaccattatcgtgctagacactctatcaggggatgttggcctggcaggatgtcaaaatagaaaacatatctctttccttttcttatccatgaaaatacattgaacaagctcttcaatttgcactcctgggcatgccaggagcaagactatttccgagagatcttccctccagcggagtttgcgagcatcatcccctcggccatgggtggtggcactaatcagatttatctcggggagcacccgatatatgtgtctagctctacttctccaggtttcccgtgtaaataattccacttatgggtcttttacctggtatacttgaacctctctactaactcggggccctgcttgctagaaatcccttaagagaagtcagaagtagcaatagcatccacaaagcaactgatacaatccattgtcttgcatctattctccccttccccggagttcactttcaatggcaaaaagggtatgaatacgtgaaagccctagcggagaaacaacagattcactaaggcatctgcctcattacgtgcgcgtatactttacccttcgggggcatgatgcaacaatacaacgatgagtggtaacgaagttgaactaagtgaggactcaatctctttagttcaatgcccctgactcagattacgagaaccgagtgttctattcagtcgacagagcttattagaaaacaaattactgcatgtatctgcccactagcttcgaatgcccagtagcaggaacagccatgttcacgcagattgattgtgatggatgtgcaagcttgaatgaatcttctctcatttaaaatatatccaaggctcttgtaaatatgatctcgtcaagcttttcattcaatttagaatcatggattgccggactaacaatgtacatatgccataaccattcattaaaatcattagttcatgcgatacaactctcaagccaatctcttgagacaatcaatacataacgtatgcagcaatctgcctgacttaacccattataacagatttccggcgaagtggactgctcgcttttattaggggtcacggtcagacaaagaaagggccgcgccacacatacatacaggtgagacgagaagaggctgccctagagaagaagggcaactccaagataggcggccaaaaccataccaacggcggctgtgccgacaaactgcgagggcgaagcagcgctatcgccgtaccccgcgacgttgacgtaggcggcacgctcggaacacgatgtggcggatggcttgttcttcctcttagttgtgctgcacaccttgacacgcgtgtccacaatcgtcacgccagtcatccacttggccgtctcggttactgtggtattcgaagcctgggcgctggccgccgtcttggtggcgcagacggcattgttggagttgagcgtgcagtcgtaggtcgtgccagcgatggcgacatggacttcgttgggggcctgggtgaggatgacgcccttgaagtcgccattgcacctttgaggggtgacccagttgttctggcagccgagcagataccgcgtagtggacgaagatgaggtcatgggggaggcccagatggcgacattgcccgtgttggcaggcggaatgaagagcgtcgtggtgctcctcctcgtcgcaaacgtgctgctcgacgcgagagcttctgcgggaagagttgcggccagaagggcggcaattccagctttgagaatgttgaatcgcatgcttgcggggctgactttgtctcagtgattaggagtgcctcggtaactgggatgaggaacgcgaccgatggattgactgacggattgacgacttgaaatgctggtcagggtcaagttcttattgtcttggtcttcagccgttggtggttgcttgtgttacatttgagggccgcgccacaatgctacgccctaattatttatgtccttttgtttcaccctaattccgcctgttgggttggaagttctttggtcattgattttttctcggcttaccttttccatgggagctggtccatgcagttacgcaccaacgagttgcaggcgccaatcccaagtcatgccgcaatcttacgcccttgaaggatcaatcccattggacagaactggtgtggctgacgtgaattagatgcagacatgcaggattcagcccctcaatcagccctgtacatacaatgccaagctagccaacgggcaagcgatgtcaccacccacatcccgtcatcaacgagacctggactctttcgttgggatcgtccccatccatgaccagctggataaaagctgattcctcctctgatttgcccgggaccgccctcatcccgatgccttttgtttaagggtacgaaagaggcattatcaatcatgctagaggtgggccaacgctcacttggcatccgccacgttgacaccagccacctcacgctgattacgccaaccttcgtgtagaaactccgggggcaattccttcatctggcattcatggcaatcagccacacggccgaatgctcggcaccgggtttagagagaggagcagccgttgtcaggttctcaaggtccttttagacgccggcactaactgatgcgatcttcttcatgggttggcggatccatacacacaggcccaggctacgcattgatcaactggtgtccaaattctacacatcattggtccgcaggcagagacggggtacccagccctaaatccatccttatctcgccagctgttgaatttgatgcttcccatctctgcttgtacgcaaatgaaggcagctttaaaggacatacaacaaagcaacacaccacacttttatttgggtacaaagactcagtattttagtgctagggtaagcaaggtttgagacatgaagatcggcctcttcagtggcctgccagacactggacatcagatcatacatcgagcaaaaagagttagatgctacgcacaaggtttgagataggctacacttagtaggctaataaactagccatgcattcaaacttggccgcagctataaatattaataggtatcaaaaatgagtaaatttgtgtgcgattgtgtattgtggtgactactcaaaccacaaaaagagcccagacgggttcaaatggtgcgacagtagctgccaagtagcttcatgatattgagtttttattcatatgtaatatagaattttagaccaacagtacccaacatcttcattcatcaagattctagtcttgtctttgtggagtgtagggtaagccggattcggggagcttgatgccacagtaggcagataattgatcttggatcagtataatggcccatctaaacgaatcggttgaagaattggatgattcttaataccaaagactggatccaccaatcgagtttatcaactatgatcttgtagccataacttgttcatatggataattctcctatgatgatcccagttgatgcagttgtaaaaacaaactggggttaaaacctgttgttgaatttgagagattatagccactataagttagtggggtcagatcgctgttagcgatcctgaccactagctgctagcnnnnnnnnnnnnnnnctgctagcgatcgcaaccactagcttatagcggttgcaaccactagcctctagcgattgcagccactggccacaatcgctaataaccccctgccaacgctagccattattaatatataatagttagataatttatattagatagaggtttaagataagttagaattaaactaattagatattattctaagtagtataattaaattattataagctatataatagaagttactattaatatataagtattataaagctagtaataatagatatatagataattatattaataactatctaagagagtatttctatctaataaaataaatctatatatataataaggttattacttattaattacttatttattactctatctaaataatagattaactcttattagttattactcttcagtagggtctatgcttatatataactttatacagtttaatagaggcttttatttataataatagagaatctaaatatagaatctactagaactctaaacttaaactctaatataactaaagaaaccttaaaaactaagcagaatagtaatataagaagagaattaaataatatattaattagatatatatatactatctaaaagctaagtataaagtattagatctagcctaatataataatagtaatataaatattactaagctatacttagaataattctaatattaggaaaacaaagtttaaaaatactataaataagatatactatctctaatagataatagagaaaaaagtagaatagaggagtaaggaataatctctactaataaaaaagaatagataaaaaactatttaaataataataagtaaaataagcttaaagaataaattaactagataaaaaataatataaactatctataatagagctatagtatagtaagaaataaagaaccctaggagtaattaaaataaaaagcttacttaatatccttatagatattaagattaagagaaactaacttatagtatagatagactatagaatataggaaaattatatcttactagtagtaattaactaactctatttactatagaaaaaaaaagaaaaactatataatataataagcccagatagaatatagtttaagtataataatagaattattaattctaaaactaattatcttataattaagatctaagaaaagaaattcagtataatatataatatactactattagaatcctataatattatattaggaataatataattaagagatataaacctactaataaattagtttactagctatatagagtagagaaatacttttataaatctctattagaattaatagaaaataaaattttattagatattagaaggattaaataaactcttaataactaaaagtactactatagaaaatcaaaataataacttataataaaaagtagatataatagttatagttttaatagtattataatctaatactataagaaacttattataataagaattaagataaataatataagtcttagattaaatatagaaataagagagatctctagatatagctttagaattaattaattaggaatagttaataaagaaataataataataatataaaattaaatatagctaataatagaaagagatagaaaaactattcttagaactatttaatattagaatctaagaatagaattaaataaataattaataaaagatataataaaataagaagagtaatatctagtataaatatatataaataaaatacttaaaaaaaatagcttaagaatattctatataaatataattactttaaaaagaaactattctaaaaagagcttaaaataaagctatctaaatatagctagtaagattataaaatctctattattaaaaaagagaaattagatttctataaactatataatcttatagaaccttagttataaatactctataaatatattaagggtaggctggttatagggtagcctgggtataggttagatcgtctgagaatatcctaggatttttcccggattttctagacccttatctgggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagcagctagtggtcaggatcgctaacagcgatctgaccccactaacttatagtggctataatctctcaaattcaacaaccttgacctacaccgtgttttcgcgtctttaaccctcccacccctattatcttcaaaacgcaataacttcagaatataaagactccaaagcgtgcctttagcactaaaataagtgcaaatcaacaaagaggctatcaattttctcccgagcaaaaagctgcaatatacgctgagttataggccagcaaaacctatcgtactatcgcggaagaatataatacaacagcctcaactgtatacagtatcttctgttgaatttgagagattatagccactataagttagtgggttcagattgctgttagcgatcacaaccactagcnnnnnnnnnnnnnnnnnnnnnnnnnnnnnnnnnnnnnnnnncctgccaacgctagccaatagcgattgagatcgctatccgatagtgattacgatcactaaccaatagcggctgcaaccactgtgggtcagtggctacagcccgctatgaccgctacggcctagcgggccctaggaaccctcagggtatgcatttatttcctatgttcacagaggttacgaaaggactcatgatggaagaagccatccatacagaacgagaaaacaaaagactgcctgtgttggtatactaaatacctccaactagcagccacggcctggaagcctgttacagagcggtctgcttagtcacgaccgctctggaaccggctttataaccggcccaactctgtagctaggatagcaactcaatcaataacttttacacctatctatctacaagcgtacgctttggaaaagccttccaacaatataagataaagttatctcctagctcccctaagccttcttattaaccttataaaaagaaggtaagaatctaggctttattatatataaaataggctaactctcttaatctatctggataataatcttatccaaggttagagatctattacttccgttagaactagcgggctatattaatataactcttttctataaccttattactatttagagcttattattatctttagatttataaactatttaattaaatagtttattattatctactaaaagtttctctttattaggcctaagttagttaggaatttagtagcttataagagtatctatatttataagagcctcgagccttgacccggcttatccttggagctacgggttaaggccggctaaaggcatcccttcggccatataaagcattcccaacccacatatagcctacttagaagcttcaagctttagtactcaattraattacaaggcagccttattttcctctacctgactattataccctatagtaagattataataattctaaagcttctacccctagttacctagaggaagatagctcccgcctttgtaacccgaagcgcctcaatgtatgcccctgaaaatctcgcacccgaagacctccttgaggagacaattgaggagtaagagcgaggaagtcataacaactcaaacgaaagggataagaccccaaacaccgatcgagatacacccgatacctccactgaacctggagccaagagggatacacctgctgagaccctcagcacaatagaagcccatatcacggacctcatcgaacaagagagaaccattcaatatattaaggaagcccaggcttaagagagggagctacagcaatcccttgtaaagctccgaggggaaatcataaatataccctcgaagcccaggtgaaactcatccggcagtaataacaaccgagacctactgctccctgaagttaaacccctgaggttgatacttatactcagataaagggataagtagctgagtgatctcgaactcacctatgaaggggccccgaagaagttcaaagcggaaaagaaaagggttctctttgcagtctaatacttagaccctgaaccccgagcgatatagtatatacacctatgcgatatacccgcgaaagatcaagaggtaaataagacggatctagactacttctaatattagaccctcaccctaatcaaggatacagctaaccgcgaggctataatagcggacgaattcgaggaggcaaagcagtgagaaaatcagtctcctcaggagttccatacctatctcagctccttagaacagtattttgaatatacctctgaggtatacagagcctcaatcttcttttccaagctagataaaggccttaaaaaccggattaagggtttaggaaagaatatccccttaacccgagataaggttataaccctcgcgactcgcttctaggaccttactataaccaaacataagtataccccctcgggtaaattataacccaataagactaactaaccgccgagctacagtagatcttaaggagtaaggccagggggtagaagagaaggaggttagttatataaccagagtagcctaaacccgtatccgccgaaaggagagggaaaccctctcggaagtaatagcaaaccccttcgctactatcaatacaacttaacagctcaccttctccctgcctgtcctaataaagcctcctataagctgggaaatactaaccggtcaagatagaggacccagtcccggccgaacagtaaagtattagggttatacaacagcttaatattcctattcagatacaaggacgaaaggctatcgagacccgtactgattaggatacaggagccgaggtagatattataagctatatctttgcaaggaagtatctcgagcaagtcagtatacctataccccttatacgggctgtaggggaaataacagtcccgacttacggggcttggaaggctataatcacagctactaacttacgaggggctatacaaacatttatacgaatacttattatactcgacagggacctgagaccagagggaagccctatccttctattaataactacaatagaggataaagatatcttcttctatccgaaagggaggcagtagtagtacaatataccgctaaagcaggttaaaataatacaccctgctcgctttctacagcagtaccaacaagtagcctgagtattctcaattaaggcaattaaggactttactcctttcccggataagtatccctcctctacaaagggaaaagacgaggtaccgaccgagtttcaactatataccgatatattcaatacagctaatacggtaatactcccacactataaggctacggatcacaatatcaagctccaagaagggaaggagcctccgtacgggcctatctacctgttatcccctaccgagctagcccagctgcgagaataccttaataagaacctgaagaataggcggattcatccctccaagagtcctgccggggccctaattctctttataccaaagtaagatagaatactttaattatatatcgattaccgggggttaaactacctaacggttaagaaccggtacctattaccccttatatccgagattatagaccgaatcaacagctgtaagttcctcactaagattaatataaaagacacctactatcgaatctgaatctgtaagggagataaatagaaaaccgccttccgtacaagatatagctactttaaatatctcgtaatacctttcgggttaactaatatacccgcaaccttccaatattatatctaccaagccctgcgggggctcctcgatactgtttatattgcctatctggataatatcctgatattttctaaagatcgggatatatatacagcctatatcaaagaagtcttggagtagatatataaggctgaactgtatactaagccctctaagtatatattttatcagcagtctatagaattccttaggtttatcctattaatagaaggggttttaatagatccttattgagtatagactatataggaatagaaggaacctatattatactataaaatccagatcttccttaggttctataacttctattgaagatttatctatagatactctagggttatagtacctctgatggagttatttaagggaagtaaggataggaagaagcctgggaatctggtactccctattaaggtaaaacaggcatttcgcacccttatcaaagctttccaaagtatacccctcctttattatttcgattaaacccggctaatcagggtagaaactgatacttctaacttcgctatagcagggatattatcccaacctaacgaggaagggcattagcacccgatagccttctggtctaggaagtttaataggactgaggtaggatacagtactccagataaggagatattcgcgatcattaaatcattcaaatactggcgatactacctcaaagggcctgagaaacctattaaggtcttatcagactactataacctgcaagggtttataaagcagccgcagctgaacgggagataagcccattagtatatattactagcaccgtataactttattattaagtaccggccaggtaatagaaaccctgccgatagaccttcgagaaggcctgactatacaggagaaactccaagcaaccttaacctcttgcctatacttactaggaagatagctactgtagaatccctccgagtaactatagcaggcttatatatagccacagaggcctaagtaggatccatttactacagggccctaaccaagggagcccaggaggaaagccttatataaaacaaaggaggtatagccgagacccgaccaatccctttagtacaggcaagttcggagataagtctccctagagaataatatattactagggcacaggcctatcaggctgcaaaggataaagatatctatatactggtaatcttaatatccctagtagggataatctgagaagcccagaaggctgataagatatcagaagcttttaagaggggtaataagtatataaaaagtaattaactcccagatagttatataataaaccctgagggactactatatttcaaaaaccacctagtagtatcagaagaggcagccctgcggtataagattataaggatttattataataaccctcttgcagggtattttaaagggaactaaacctaagagcttataagtagaaagttcttctggctagatatagatatataaataagagagtatattcgagagtacccagtataccaggggatagttataaagaggtatcagctatatagcgccctcgaacctctgctaataccctcttatccctggagctaaatcagtatagactttattacgggattacctgttaatatacaaaggtataataaagtagatataatatttattatagtcgatagatatataaaatactcccttttctttatagtccctagtataattactactgtagaattagcagagcaacttccctgctgcgttatagcggtctcaaggcccaatacaccttgaaggccactgtaatttcaacaagcttaatattagcttataatataagattctaaattaaattaaattaaaaaggtataattaatctgagacctcctgtattctagcttagtatatataaaattattctttctatagctttctgtatattattctatatatctattattttctatattatatctattataatatttatatctaacctatactaattaaaaccttattctagctatattacttgctctataagagactatatctcagctgagggttatatatactatatctgagcttaggttatctagttcagataattcccagatatacccagtaactcttctctccatacctgatatttactaatactcttgttgaaattacagtggccttcaaggtgtattaggccttgagaccgctataacgcagcagggaagttcgctataacttacagctctcaactactaactccgctataactcagtgagtttcagtgctagagggacctaatatagtgcaaaatatagcgcaaaagaatcttatttttrtragagagaccagaaaattctatctaatttctcttataggtctaccgactaaaaactactctaaatcccgctaaagctgcttcccgggctacttttaattttccgtaaaattcattactataggaaatctaaaaaattaacttataactactaaaaccttcgactgatatatatagcttttataagacccacttttatctgaaagaggctcttaagctgataaactttctaataattctattttatttaattctcttctatctaataatactaattaaaatagatatttagattataataattattaagcactagaggaatattatcctctataaatatattaagtattagatttatttatatatctttatattagttaactactagataaagtaatagttctagtaggtataactactaggcctatatataaaagagtagctttattactataaataagcttataatagaatataggcttaaataattaatatctaaaaagagattttaatagttattactaataactactattatatatataagaatctaattacttataataaccaggctctagctatagaggataattatattagaggtatttattattattattataaccctatataatataagatttagtcttagaattagtatatagtaactttataattagctattactcttctcttaaagattctatagtaataactaactaatctactataatactaaatattattaaattaactttatttaatttaacttttctatctaataaactttctaataattctattctatttaattctcttctgcccgataatactaattaaaatagatatttatttaacttaaagagctaccttagcccagattaacttaagctagtatattacctgctagtactatatatagtaccttaggttataataattattaaaatttaattaattaattactagatatctagtaagtacttatagttataatatctaatataaatattctaatctcttagagcctagttaatacttctaataaaatccttaaagtaataataactattatccaagataatctaatatagctatttactaactatatttattatatatccctctagttagttaagggtctacttatagtaataaagctacttttaatattatagatccagtagctatatctacttagtctattactttattatacagtctgcctagtactactataggtacttatagagaatagaaactagctagaagaaaagctatatcttaagaatagctatctacttatatagatctactataacctaatatataatttatagtttcagtatattatatactatattaagttaatcaggatagagatagctcttaaaaattaattatttaagctttatattatttttagttatattcagatcaggatattagtcttattagattaggtttaatattagtatatcagagtttatttcagtttaatctaaaattatacttatttaggaataagaaaagttaattatataaggttattagttaatttatctctataagtatagtatatatttactactatagaaggtttttattaggaataatacagatttaatattaatctaatatctatttatatatagttatttatattatataataatagactatatataaagtaagtatatagtctgagtatattaaattctaaatcttagcttattaaaataactctctaacctttatactagctataatagattaatttataaagagggtaattatagtaatatactagatagctcttttatatactaaggtctaggatttttatatagtaaataaggtattaagtaaatactaaagagctagaaaaagctatatatagcttagaggatccctaactatatagaatagaataaatctattaaactagaaggatatagataagcagctaagagggaaaaactatagaaatagtagctagggagagcaggcttatataaagactctataatatagtaattatagaaaacctaattataatatctaaatctatagaaaaactaaaaagaaatctaataaattaatttctagtattattataatagataattagttattattattttaattaagtttattatataagggatagatagaaataattagtttacttatataatcagcttacttatagattatattattctaatttaattataaaataatatattaaaaagaattagaaaataaaagaactaatacttttaattataaattagaatataagtagattatatctaagataaatagatagttacttactataaataataaagaatatttagtataaaaagccttagaagctatacttaagaaaataatatatactaagatctagataaatactatttctagcttagaaaaactataatagaaagtaagaatagtacttattaagaaaatctataagtatttacttttaaaatattaaaaaattaaaaaaaatatttaataggattaaataatattataattatctaaatctataaaaagaaatataaactatagttatagaatataatatatatatataaattaaattagtataatataaactatatagagaatttaaactaattttaatactagaataactataataattaatatcctttaattatattattaaactattaaaatccagagaactaataactaaagtagaatataatagtattctagtagttattaatagatttataaagtataaatactttattctatataaatattaataactatctaaaagagtattctatctaataaaataaatatatatatataataagtctattatttatctattatttacttattatttattctgagtaatagattaatatctattaattagaactttaagtagatctatattttatatataactctatacagtctaacagaggtctttatttataataaatagaaataagagctatatatatatatagtattactatatatttatctatagatataaagaaaaatatattttaatatattattacttatcttcttcttattactcttactaatatctaggaatcccctatttaccctagctatataaaagtctagcagaataccttctctagtttacttagtatatagtctaactagagcaagtagagaattattactggagatctagatattaataataaactccaggtttatactagctcaatttcaaacattcagattaccgggggtgagatcctgcagctggtactatggaaggattcctcccagttaaaggggtggatatcaggccgtattgagagtcagtatatctttaatttgaacttgtctgacagtttcagccatacggagcaattcacactaatacataatagaggctgattcgatctgcagatgagtgctgtgactgctgtacggcagtacttttccgtgaatgacatcaagctacccacccagtgtagattaatattcgttttctctttctgtactgcttgtagagctatgtgatttcatggttgattcaaagttggtagagatggtaacatcttacatgagctgatgggacgtcggtgatgatcaccagttggatcagaatccctgacgaataacagggccctctatttcctgagcacaacagcagctctacaccacagaaaggagtgggttaaaccgccaattaagccgcggaacatctttctcgccaagcaggtgggccgaatggttcttgcattagagggccgatagcgcgtccctcgacaagggatcggggattgtccaactcctaaatcgccgccccggtccaagtttatccatctggaatagacagggccatcgggaccaagccagcctggggctgagaggctgaagcggtgcgtttcatctgtggtgctcggttcgccttggctgtcgtcccggctccgctcctacgatcctaccatgatccttgagagccgtttgtcatccacagcctcctcaagttcgtctacgcctcatgctgggccagcctccgaccttgatgtagaggggcaactgtggcttgcgtcctccgctttcacgtcgacttccaacaccatcaattcaacatctaccgcgtctccgtatcgtcttggcttcattttccgtctgggtcatgtcgtgtcccaccagcccagtctgccgtgatgccctctcaattagatgattcccctcccgttcctcttggccaattagccgcaccaagccaagaggacctggccaatgcccccagcgaagcagtatgactcctcgatttcctgcaaaccggcgagcaggacctgcaattcctcactgatcttcgaaacgaacacatttccgatctcgaacgacagccaattgtgctgcggcgggtggacagcgtcaaggagggtgcgggaaaggccctagggcaggttcgccagcttgttaacggagggctggacaagctccgccagagcaggtcgccatttcgcaagaggaacaccaggaagtttgtcgagtcggccgagtttcgcagccaggaggctgtcgttacgaggcaccatgcggccattctccgcgaactggtgcatttgcgacagcttgccctatggagccctagccctgggcagagagaccaggaatccagccgcgatagtgtggtgagttcggaatccgaggatcgaagatcaactcccagcatatcgactccgagcatgttggggaggacggagagtaagcccaagcttgacaacatcggactcctcgcggacctgatgggcgatgccgcatgtaagtttggcattgagatcctgcaacgctcgtagccgttgtctctgacactttcattcccacagtatcggaatcgaaaccagccatccctccacagtactcggccatctcgagagcaatgttcccccgggtagagatgcacggcaacacaggtcgccgaacagacagcgtctcctcgtgcccccccctccgagctcggtatatatggaaaaggttcaatattttaccccgttgagctcagcgcagaaccaaatacaaactttggcctggctgaattagctggagatattccaactactctaccgataggccccgtctccacgccccagctaatgatgaaccccgaagaaaggaaaggcctgtatcagactctgccggcttacctcatcctccatccaagacgagcactgatgcgctacaccggtccattagttttgacccgacggacgaccgcgatttacagcccttttcaccgctggataatcttataccattcatttagctactaccggttattaaggaaaagcaagtggtggcagacagcagcttttttggaccgctattaatcagtgtgtacgaagagaaagagctcgtcgtctgaaacagccagcggaagaagtcgatacagcgcattggtctaaacgagcaagacagggccgggcttgcgctcctcatgggagatgacatgggatactcgggccactatgttgcccacaagccatctacggtatcgctgatgtcggttaatatacagacaggaacttccataacatggccgagcccagctatgagcgagcagacagtgatgataccgccagtccctaccgaggcgccgccgcctccgcctccgccaatgtcaccaaaagttccccatggcatcattccaagaaagcccacaccttcacaagtccgctctacgacatcagtgcccttgaaaaatcaggcctcagtctctagttttaatgggggtacagcaccagccatccagccgctgaccacaattccaccggagctgctgtttggacagacaaccacctccaagggccaaccccagacagtccccgctattgttatccaaggagcgcctccgtgagagagctgcacgaagcagcgagagacaggtcacaggaggcacaggatgtacttttattcggctttgggtgaggcaatgggggttatcgcaatgttttattatgttttggacaggtgcaaaggcgtttggcatactggggataaccttgaaatgatgggcagttggatttcgacagattctaagatcataataacatcaattgattcatgctggcgagctacttcaacgatgcactatctctgcccagcgcccatgccaccagaatatctggattctcctctacctcgcgtctaaagtccctcaaccagaaccaactggcctctgactcgtgatagaactctagccaagtcatgaaatgtgcgtcctgcaggaaaggttcctccacgaaactgacatgtctcctcatcctcgtccacagatcgcggaactgcgcatgaagcaccctcagggttgccacgcgagaatatgtcacgcactccaacccttcatcctgcccatagttgtcccactcctcatcgtacaccttgcttagcattctctgcgtctccttcttgtactgttgagggatcggatcgtatttgacgcaaaaccagccccgtgtcagctgcaaccccgcttggtgcagcagcgattggatcgacgtcccgaagagtctaagcagttccctccccagggcctcgcgcccgtattcccgcacaaagcacccgttgcagcgtacctcgtcaagggtaacctcgacagtcacgtcgctgtgaagctccgtgtaaagcttcagccgtcccatgccattatggaccggcttccactgcttgaagtggcccccgaaccgaaacgcccgcagctcctgccagcgctcgcaccctgaacaccgcaccatgtacattgtccaggtcccctcaaacacgtctgctcgagatatcttctccttgcgcaccgggaagggacgcggcccgctctccgggctgtcttctagccctggcaagtagcggtcaagaacagagctgaaagcgagacggcggctggtttggatgggccctcttggtgtgccacccgggtatcccaaccagacgatgcgcgcaacccccagcccaagctcccctcgtcggtaacggcactcaccgaagacgcgcgcatcccagctgttcgggaagtacagttcggccgtggccgtcctcttccccagcgcccgcgaccgccgcttggcgtagctgctgccggcgggccttttggcctgcccttctccctaccaaactaggctcccatgccgtgagcgcagtcgcggctggcgatctgggcgacggcttccgataccgtcgcctaagaagaaaatggttgtcaaaatgagtatgagagagaaggcgaaggcaaaatgcgcatgcccagcgactctgttgccacgagtcagtgttccagtctggaccagccacaatctggtctctgtctaggggcaggatggcaggcctgtcacctccatactcggggaggcattccagtgccaggaaacgctctatctgctcagcacgggtgggattgatggtccgacggaaataacggctggcttggctgagggaaaagaggccgatgggatcaagaagacggatgatgaagcgctggagctcaacggatagtgattggagggatgccggctgggttgtagcgtctcccatcatgggtcaatggccgactcttattggcaggttacgggggcagcgaaagaagggatagagcagattcgggaagatgagctgtgaggtcgatttgctcgtggaactacgaggccgacaaagttgggctttagctcgcaactaagataccggtgattcattctcacacgtgtcagatctgtcagagagatccattttaggcacttacgcactgctctattgataggtagatagtcgtcggttcgtttccatcgcttcatcagcttacccaacatcgccatcacgctcaagcgtaataccactcactccatggcttcatccattcctcggccatatctcactctcctttgctggaatttgattgcccgctgcatcttcccgattgatccgtccagtttcccttttgggatatgctttgtgcatctgacgcgtattattcacccacaccgtattgaggctcgatttgttcccatcaacgactttgccagctgttagttcaatttattcaagctaggagctcgtctactagccttagtaccatgcctatttgctggacatcctttcccatcatgccccagcaatcttcattcaacgcttcttcctcagcgctatgccaattccaacccctacgtgttaaacaaaagcttttgccatgatggcttaaagctcgttgccgttgctcaaggggaactgcccctccaccacagcaccatggccatcatcatgtgtatgttcgggctttacatccacaatctgcttggcaagatcgctccagaaggagcacgtggacctggagttcttggagtccgagcccagagtaaacgtgttaccattcaacgggtacgtgactgtcagaacatccccgaatttatcaccttcattcgtcacagtaggccagaatttatcgccgaggctgggatcattggggtggccgtgaagtgtgagggaagcaaaatatcgttggaagggcgctctgacctgtttgtcaatcatagaggcgaatacctccgctgtcccctcatcaataccaagtgccagaatcatgttcagagcctcttcgtagttggtgacgaactgtggaatgaggtccgtgccgtggaaggcaccgccatcaaaggggaagttgtactgcatcaggtaggacacgtcagggtatgcctccgctaggtcccgagtgttgcaggtaaagacggcgtgggcaatgatggcggccacgcacaggcggtagtcgccagaccacgccttcttgcagtcgtacttgctcttgatggcggccctctggggagccagagccgagccaggcaagaattcttcgaggtacgcatcaaacttggcctcgctgtccatgtctttgggggagaacaggtagccctcatttgcaacatgtgagatgatagtgccgctgatttctttccaatacttgcctaagaatcagtcagttgaaagttgcagttgcagttgctggacaattaaaggccacttggtgggtgtggaagctgtttcttaccctcggaaaaggagatggaggatagtgtcttgatccatttaccatccaccgcaggcccgacagggaaaagaccagtctgtcgcaccgtatcaaagagttcctggttcgccttggcaagatcagtaacattggccttgcgcaagcaatccatgtcataggcaaactcgcatttagcaagccgcgagaagttcctgtatatagtgtcgagcttgccatcagaggagttatcccaagcccactcaaagccgggactctgggcagcaaaggtacggaatttgggatcgactgtaccttcctcgcgtataaggtggtgcagaattgaacttgctccggctgactcaccccaggcgctgacgctttctttatcgccgcggacttggtcgatgtattgctgcacccactcaaagagaagcgcctggtcgtatagacctgcgttaggctgtccagctttctccatatagtcgccagcgagccagccaaaagcacctactctgtagttgcccgcgatgaagatattattataaccagatgcctggagaccggacttgcccgtgtataagggcccgccttggtcctttgagccgaacgcatagccaccgccataaatccaaacggtgactgggaggcgggtgtctgctgcatcctcctcgaaaacccacttgggaacatagatatcgaggaacaggcaatcctctgtctggttgttgggaggatcgtgcgggtcctcgagggggctgccacctacaggagggtgtttcaacttcttagaatcaatctggatacaggttgtgttgcggtccgggctctgaatagtattattccttaacttagggaaggatggagcagcaaaccgaggtggctcctgtccaaagcggacgtttctgaagaggaggatcttggtttcagggtcagcactgtcgacccgcgtatgattactcccaagtccatgttaatcttaccttgtcgtcatctgcaaacacttcagcctggtattttccccaaggaagcgagattatgggaagatcaagggcatgagtcaagcccaagaaggcgctgagagtgaccagcgaaagtggattacgcataatggtgacggaattagtttccaaaaggtgctttgacaaaatttgggtttgagacgccaggtgagggtagggaaaaggggggggcagctggtttcttttatccatcatctctccgtaacatattgcagtgaatcatcgtccaagccctcacccgtccaccctcatgtttctttcgtcacgctaaggagagagtggctggctgaatccaagcgctgcatcaagctagaaaagaccaatgcatctccctcgcaggttaaccctcccgtcgggaaaggtgcaaagtccagtttggttcgttgtttccagtgactgacttggatgcctcctgtaggtctcagcttctgtagtgatgattcgcaccatgacaacaacatgacaacagagaatgagaccgtgcgccgctctgcactcagcaatttgcggacattaggcttgatgcccattccgatgcatctttgggaaagttccgtggcgcagtggttggatgaccggcattagtctagcggcatcaagaacggcattgggaggccaagagtggatgaatgctcgtaaaccgtatgtgaagagctatggccgggatcaccaattgcacattaggaaatgcagtgaaaccaacaaatggcttgcatggtactattgttttctgggcttgtaggaatgcacccataacaaatcatccggcagtgaaacgcctccatcagcccttctgccgcacgacgtcaagaaagtcccgccaatatccgagctagatccattttgcagggtgatcggaggttgagtaatgatgatcccgcagattgccggcgcaggtctgtcttagcccctgatttcgccccaagagacgccttgactgtcccgaagatcagctcgaacattggtatgagtgtcttgaccagacgagacatttgtctagcctggactcaatttgggtgattcagctctggttttctgcatggacgcacccatttacatgacatctaggccgagacttcgactgcaaaaagcaattttgtgagcaaaaggacagaagaaggttatgcggatagagtcaaagcgtcctgctttagtatctagaggtaccgaatctagtaggatgaagaaggcgacgcctaggtattgagctatgttggaaatgtgacactatccaatcgcccatttcatccaggtgttcttacgcgacctggcccaaagttaaaattgtaaactggctattaaagtgagcttattcttgggaacaaacttaggctgagaagtcggtatgccattagccgctgatccctgagacatggcgtggataaattatgccgaaactaaactgtctcaatacacccaaaagcacatgagagtaaccagtcgggccattgattctgagccatgtctggccgaaacaaccttcaaaacgagcagcatcctgcgcaacacagccactatctcagccgcttgaaggccaaacaagtaacccagtccaaatcatttaccttttattaggtatgaacactttcaaaaagaaaaaagaaaatcacattacacgttggacagactgctctggtggaagatggatatttccagaataattacatcgcatgcgctgtctaaactccgcttatgcgcagcaaataatcacagccactaaattgaatgccgaaacccttccggcgatgatcaccactcatgtaacaaactggaatcgttcatcgggccgaggaatcggtggcttaactggggtttttcgaccgaaccagaccacttgaagcaacacttccacgagagggagttgtcgtacatgtttcagatagtctagcctgttgctgaaagatgttgcattcctgccataaaatacccgaaacatggttttatttggatgggctcgaatttgatatggaccatattccacaaccatgtttatgttccagttcatgttacttcgacctttcccttacaaccagtacactggatttacgccacttgggtgtcataggaccctgatcgatgtgttacccctcagttgcaggagtaaatgagtatcgatagggggaagtggctgtactcatttggctagtgagggacaatataaggcattttcaacttcttgtaggtataagcgacgccctagccactatccggcggcgattccactctaatccttggtgggaataggtaaaagtagatactaatttagactagattctattagagcaggtttattagtagtagggttaatataaccctaccccagggttaatagctatttccttactctaaccctaggaatcagggtatataattaaggggctactatatataataaagtaagtaattctactatttatataattctattttctagataaacttatctttatctagtaagaagctataatacagagcttagttatacttaataaagagtattaagttcttatttataataagtataaagctactatataccctggcggtaagattaagttatattttcaatataaatataatattaagagctagaagctagctaagatcttaagctactttaagtattaactactataagatcctgttatagttatacttccagtagataggagttaactgatcccaggattaatagtttataagtaaagattaagctatagtaagtactgctttttaataataagctataatattattataaagtattagagaataaatataatatataccgggattatagtataatatactgaggtcaagctttagttatagtataagggatagtatatttagtactgggttatttaactagtataggagataactaggagcttaagagcagtacttataactataagaagtactatagatattattatagtagagagtactataaagctgaaagaagataactaaaagagattataatatagcgataggtaagagggttttaattataacttaatatagatataatagttaggtaattaatactaaatagagatctagagtagattaggattaaactaatagagtattattctgcatagtataattaaattatcttagtactatataagttactactaatatataagtactaaggagctagttttaataaagatagtagtaataatattaataactatttaagagagtatttctaattaaaaaataaatatatatatatactaagagttttattagaatatttatattagtttttactctagattttactttaactaaataaaattagttcttattagtttactaagataggttttgttgaatttgagagattatagccactataagttagtggggtcagatcgctgttagcgatcttaaccactagcctctagcgattacggccactggccacaatcgctaacaatcccctacgatcactagccaatagcggttgcagccactgtgggtcagtggctacagcccgctatgactgctacggcttagcgggctccagtaacccctgtagggctaggagcataagcagagctattaataggttatcaggcttatcaagcccagataagagtctagaaaatccggaaaaatcctaggatattctcagataacctaacctatacccagcctaccctatagccagcctaccctagactaggtcttagatcttgaataattccttcagctttaaagataaggtatttaatatctatactcaactgatcagctaaagagcctctttcagataaaagtaggtcttataaaagctatatatattagttaaaggttttagtacttataaattaattttttagatttcctatagtaataaattttacagaaaatcaaaagtagcctaggaagctactatagcaggttttagagtagtttttagttagtagatctataagagaaattagtataatcttctagtctctcttataaaaataagattcttttatactatattttatactatatttagtctctctagtactaaaactcactgagttatagcggagttagcagttaagagctataagttatagcgaacttccctgctgtgttatagtggtctcaaggcctaatacaccttgataactactgcaatttcaataataactattaactttatctatagattattctataatatttatactaaaaaagaataggaaattataatttattataaactactaatagcttaataaaattatatataaagatagaatactcttactactgattatagaactcagagattagctatagggtaaatagtagtttactatattaaaccttataggagcttataatctaatatagattaaagaaggaaataaatagaaaatagtatttagaataaagtttagtttttataagtattttataatactattcagattaataaatatatttataatattctaataaataattaattaaatactttaaaagtatctaaatatctttataattatttattttaataatattttaattttcttagataatctagaaatatataaggaatatatatataagatcttagaaaaattagaaaatataaaactcctaatagaattagaaaaaagttatttctatatataaaaagttaactttttagaatatactatttaactaaataaaatataaatagaataaataaaattattataattaagaaataggaaatattaaaaattagaaataatatagatttaatattaacttaatatctatttatatatagttatttatactatataataagttaattatatattatagaaattagtatataagatcttctatagagtttatttttttatatagaataaaatatttatactttataaatctattaataattactaagatattattatactttattctaattattagttctttagataatagtaatttaataatattttttctattggtttcgctataaacaaaggtatatcccaagatcaggcaacacataatctgacacacattttttaagaacacaattagcggtccatacccgaaccttcaacaccataagataaagttaaatatcacactttcaaatttaataatataattaaagaatattaattactataattattctaatattagaactagtttaaattctctataaagtttatattatactaatttaatttatatataaatattatattctaaaactataatttatatttctttttataaactagagtaattataatattatctaattctattaaatatttttttaattttttaatattttaagaatagatatttatagatttctctaataagtattattctagctttttattatagtttccttagattaaaaataatctctatttaaactttagtatatactatatctttaaatatagttcctaaggttttttatattaaatatcctttattatttattaagaatagttatttatttattcttagaattatttatttatacttagacttctagctaaaagtattagctcttctattttctaattctttctaatatataattctataattaaactttaatagatacttagtataatatatttattttctattaagttactaagttataataaaatattagatattcttataatctatatatatcttaactttatattatattcctaagtagtaatatttaaattctttaaatatatatataatagctataaattctttattataaatagaatagtttagttctatattatatagttttttttaaaaagaatactataagatataatattttattattattcttttagctaatttatatactaattataaaatctaatatattagttttaagttttactttctttatagaattaaatatttatagtataggttttttaaatatttagattttaattttattaaatatttcttattatttattattctattaaaattctattctcttttttataatattatataaaagtataataattttactataattcttaataaaatattagtaatagttagtaaatctaaggaaagtttatatttttttaataatttttaatattttctagttcttaactatagtaatcttactttatattatttatattttatttaattaaataatattgttaagatttaccctatagtctatagggtagatcagattaccctataccagttgatcaagtgatatcagattagtatagggtaagaaggaatnaaataactaacttagggctttccaaagctggaagccctctggagccaccggcccaacccgctgtggctgcccgttggggcaattgcattagcggtcacaaccgctgtaacggccgctgtagcgaccgtattagcaatctcgtattgcgctgcgtcagctgcattagcggtcctcgtgtccgctgcagcagctatattagcggtcctcgtgtccgctgtagcacttgcattagcagacctcgtatccgctgtacgagaaccttagtacttagttagtaaacctcgtaaccactgtagcagctgcattagcggtcctcgtgtccgctgtagtgcttgcattagcagacctcgtgtctactgtatgagaaccttacagcagttacgagcccgtattacagaaggcaatatattatcttcagggctcttagagctctgaaacacctataagtacagggcttcctccctgctagatagaggttctttaagctaccaattcactcttttatctaccctacagtctatctttcttagctaccctatagctgataaagcctctctttcctactaagtaggctgcttcttccactatacctttcaaaacaatcccttcagtattccttagcctaccctataggctgcacctaccctagacccagcttaccctacagctggtctaccctatactggaggccttgatcttttaaaaaatatattctaagatattaattttttatatatagaaatagcttttctctagttctattaaaagttttatattttttaatttctttaaaactttatatatatatttcttatatatttttagattatctaagaaaattaaaatattattaagatatataattataaagatattaaaatacttctagaatacttaattaattatttattagaatattatagatatattaattagtctaaagagtataataaaatacttatagagattaaactttattttaaatactattttctatttatcttttttttttaatttatattaaattataagtttcttttagatctagtataataaactactatttactttataactaatctttaagtttagtaattagtagtaaaaatattttatctttatatataattttatttagctattagtaattaataactaaatagagtttattatttttctttagtataaatattataaggtattctataggtaaagttaatatatatatatagctttttactaatatattattaatatatttataaagtatttataactaaagttctataagattataaagtttatagaatactagttcttcttttttaataataaagattttataattctattaattatattataataatctaattttaagggtttctttaaatagtttcttataaatataatattcttatagaatataacttatctatttattttctagaattcttctaaatatttatttcttataagtttctttattctataaatagttcttttctttatattctttttattaggaattaaatatttatatttaatctataaagtctattttattatatttttctttaagcttttattttctagctttcttatactaaagattaaacttaatattatatttatatttctattaaagtattatttatatctagttaataaaattaatatttagtagttttttaattttctatatttagataagagtttttattatatattataatttctaatagaatattattattattatactagattataatactattaaaactataattactatatttacttattattataaattattaagtataaaatagatagaagaaaaataactaaagaatattctaaaagaatatagaatttataataaactatttaagaaaactcttaaaattagtttatctaaatatagctaatagaattataaaatctctattattaatagagaagaactagctttttataaactttataatcttatagaactctagttataaatactttataaatatattaataatatattaataaaaaactatatatagctattaactttatctatagaatattctataatatttatactaaagaagaataataaactctatttagttattaattactaatagctaaataagattatatataagaataaaatactcttactactaattataaaacttagaaactagttatagagaaaatagtaatttatagtactagatctaaagagagcttataatttaatataaattaagaaaaataataaatagaaaataatatttagaataaagtttagtttttataagtactttataatactctttagattaataaatatatttataatattctaataaataattaattaaatactttaagaatattttaatatttttataattatttatcttaataatattctgattttcttagataatctagaaatatataaaaaatatatatataaaatcttaaagaaactagaaaatataaaactcttaatagaattagaactaataaccttatataactaacttttcttatttctaaataagtataattttagattaaactaaaataaattttaatatactaatactaaacctaatctaataaaactaatattctaatctaaatataattaaaaataatataaagcttaaatagttaatttttaaaagctatctctactctaattaacttaatatagtatataatatactaaaactataaattatatattagattatagtaggtctatataagtagatagctattcttaagatatagtttttcttctagctagtttttattctctataagtacctatagtaatactaaacaggctatataataaagtaatagactaagtagatatagttactagatctataatattaaaagtagctttattattataagtaggctcttaattaactagaggggtatataataaatatagttaataaatagctatattagattactttagataatagttattattactttaagagttttattagaagtattaattaaatcttaagagattagaatatttatattagatattatagctataagtacttactagatatctagtaattaattaatatagatttaatttatatatatatattatattctaaaactatagtttatatttctttttatagatctaaataattataatattatttaattctattaaatatttttttaactttttaatattctaagagtaaatacttatagatttctttaataaatattatttttacttcttattataatttttctagattagaaatagtatttatttagactttagtatatattatttctaagtagtagtatttaaattctttaaatatatatataataactataaagtccagagagattttgcttgcaaaccggatacagccacggggagccaactaaaatcgaaaacgaacccggcaatcgattctacggagccgtattgacctaaaaccgatgccgcatcgaagacgatccgatggtgcggaatactacccgatggaagtcgatggtgggcgccgcggcctggaatcgagcatccaccaccctcagagaggcctctccgacattcctccaggtcggagacgcgccgaacccgagacgaacccaggagagaagcatatcaaagaagaccctataaggaaagcctacagacaagttgccgaactggtgtcagacggggtggcccagcaaatatggcaaatcgtgaaacccctattcggagcggagccgacgcgtaaacgcgtaggaccaagcacggaagctatgatccaggaagccacgaagagcatccagacaacgattatcgaaaccatccgagaaacggttaagaagatacccaataacgagggagaacgcccagaaccgacctgggcccagatcgcgtccgacacgaacccgacacacacgcgcaccaacaacaaactgaagcccgtcccagcccgacacgcccgcgagataaccatccaaaccaaagactgccaaacgaacataagagatagagacccaaaagatatagtcaaagcgatcaacacgtgcgggagaaccggccccgaagcggttgcggccagaaaacttaggagtggcgatgtaaccatcacgttccacagggaaatcgaacagaacgcgaagaatgaagaatggataaaggcagcattcggtccggaggcgaaactgaaccggaggcaatacgtagtggtagcgaaagggattagagccacgacgattgcccagaataccgaagcactctggaaggagataggccaaacgaaccgagtcgaaattataaaagcgaagccgatgcggaaacgaaatgaaaccgcgccaagacagaacctgatcctgagtgtagcctcaccggaagaagcaaatacactatgcgaacagggaataatcatagacgccgaaatcagccaatgcgaacccttttatgaagccgtacaactgcgccaatgctataactgctatgagattggccacatagcacgctattgcgacaagcaagcgaggtgcggccaatgcgcggccggggcgcatccgaccggagaactctgcccagtagaggctggaggagatacaccgacatgtatactctgcaaaggaccgcacccggcctgggtacgagcctgccccgtactgaacagggagaaagagaagacgagggaagcatacagtaatcgcccgattggattcgcgataccaaaaaggaataacttggggccgagctccggacaccgagtcgaaaccgcacagcagcaacaacgaaccccatccgacctaacggccgaaccgaaaagaggaccaggccgcccagcaggaacaacgaaccaaagaccgaaagttataaccggaacaccccgaaaggcaagaactattatcaacacaacgcgaggggcaagcatcgccaacgcattcaaccgaatacaaaacggaaacgtaccgaacccgggtagccccctaagacaaataacgaccggatcccaaccaggcccgtcccaataatgctagacatagtcacatggaacatacgaaaggtaccgagcaatataaagaaagcactccgggcccgggccgaatacgatgtgatagcggtacaagaggcgacgatactcccgaatagaaacgcaccagcgtgcccagcgagatcgggatacacaatgatatacggaggagggagacatgcgatatacatacgaaatacacacggacccgagacgtgggaagcggaagcaaatgaaaactggtgcgcggtcagaatgttgaagtacaaggtcaagatttggaatatatacaacccaccggacccggcctccgcccgacctttgatccgggcccttagcgaactcgacccggacgaacataacatatttctcggggacatgaatgtccacgacccgctatgggacgaacacgaccgaaagaccacggggatagacgaattcataacggcggcggaacgggcccgactaggcctcctaacaccgaaaggagaatgcacgtggttctgccatgggaaaaggaacagtacgatcgacttaatatgggccacgtatggctcaacagcgagatatatgggctcggacgacgcactaacaggatccgaccatgtagcacaaagagtccggttcggaaccggacctaaagcgggagagaccaggacagcagagaatgttaggaagtggaagaggaccaatatccctcttgcggaggccgaggcccacaacaggttcggaggtccgccaccagaagtcgaagatatcgtgcaactggaagcactggcggactttgttatcaatcacctgaaccagatcgcagacagagcggtcccgacaggaccccgggctggacccggggataggaaagaatggtggactcctaaggtcgtcgaggcatccaaaataaccaaggcggcccgaaggaaatacgcggcggaccctagccggcaacggtgggaagacctaaaagaggcggagaagtcagaagagagaaccatatcggaatcggaccgggagcgatggcgaaccgcactgggggaaacaagctgggacgacgagaagctctgggccctggagagatgggccagactaagaagctgggaaccatatgaggtcccaaagataccggacatgacaggagaagggggggaaccgatacgaacccacgaaggaaaagcacaaaaattagcggggacctttttcccggaaggatcatacgagctaggaccgctccctggactaaaacggaaggaaggagacccgatatcgatacggacaacggtcacccccaaagagatcgagaacgcactcaagcacatatcgccatggaaagcgccgggagaggatggaataccaacaggcttcctgaaggcgtgcggaaaaccgttttaccgaatactcgcatatctggccactaagagcttcgaactaggccattttccgacacggttccgggccgccctcgtaatagtgctgaggaaacccggaaaaacaccagcagaaagaaagaccccaaaaggatggcggccaatatcgctactaagcacaacaggcaaagtgatggaaaaaatactaggagaccgtatcgcagccgcagcggaagcgtacgaactcctccccgatggccagatgggaaacagacgcgacaggtcaacagaagcagccctgaaaatatgtgtggaaacgatccggacagcatggagactcaaaggattagtcgcactactgcttctagatataagcagcgcattcgatgcggtaccgcacagcaggctactcgaggtagccagagtaaaggggtaccccgagaatatctgcagatggattaagacattcctagaggggaggacggcacggctccgattcgatggcgagacgacagcggcaataccggtccgagcgggcgtaccacaggggtccccactatcgccaatcctctttatactatatataagcaccttatacgaaaccctcaaagaagtccctaatacactagtagtagggttcgccgatgatacgaatatattgagcttcggacccgatacggaggcagtaaaagagggactcctcagggcatggaagaaatgtgaggaatggtcaagagctgccggattaaccttcaacccaacgaaaagcgagcttatatacttcacaaagaggaggaaaaagataaaggaccggatacagaccggaggcgtacaggttaaaccgcgtaaagcggttaaattccttggtgtatggctggacagaaaactccaatggaaaacacacacaacgaagctccaggagaaactcaagagacagatactggccctgaccggaatcgcgtcgtccacgtacgggtgctcatacagacgagcgagagcagtttacaaagtcgccataaggtccgcaatggtatacggagcatctatcttccataaacccacagagaaagggtgcaaaccacagggacctgtacggagcctggccggatggcagtcgaagtgcctccgggtcgtaaccggggcgttcagagccacgccgctgagaatggttgaaacggaagcactaataccacccctggacctctatatgaacgaaagggtagcggaaacagagaagaggttcgaggccggaaggatcgcgagtataagccgggccgcagtcagtacggtagtcaaatcgatgacgaatcagcggagacgaaggcttcgaaaagcgaagccgctgagggcgagctggtaccaaagacaaggaaaagactttgacttggaagctgaatggaggaccagatgggaaaccgaagcgaacacgacgcggaggagacccggacaaacatgggcagcggacacaacagtcagattcgacagaggggtacttaagagacacgacctcctgcgaaaacatgaaagctccctcctgacacaggcgagaacagggaggataggcttagcctctttcctctttacgaggggagttcccgaggtgaatacgcctatatgccgatgcggagaagggaaggaggacatatatcatatcgtcttatggtgccccagattcgaaacccaacgagccgagctaagcaccggaaggccgacacggacccgacgcgacctcgatattgcaacggaccgaaaacgaagcgcgcgagaaatcataaggtgggttttggacctcgggatactagaacaatacaaactcgccgagaagctggacacactgggcgaaatgtatagaaaccccgggcaggacccgacccgcatacgaacggaaaacacatcggacgacacctagacccagtcaacacaaacaacaatggaaccatcacatgtagtcaaacgggcgcaaagagaacaaaatagcagaaaagaacagagagttggtattgagagcgcgagctaaagactctaagctacggaactgatcagggcccggagcggacccggggcggaaactaatctaaggctcctcggacatgtcggtgtcgtggccagtagcggcctcaccagggacatactcctcaaacccgccgtgaccaccaccctcgacctcactctcgccgaacacaccaccaggaggaggtacctccgtaagggtgtcgaggatagcctggaccgattccgatacggctgcggccatgagggccggaagttcgcgcaaaagtcggttctggtcgaggacatttcggttgagcgtgtccaactgagcactgagggcggtcatctgtcggcggttcttctcgccctcggtctccagggtggcgacagtggtcttgtcatcgtgcagggcctgggacgaaaccagggcgggaccggcacggccgccgaggacagcggcgccagcgcgatcctgagtgccaccagaggcaagaacacaggcagacttgtcaggccggtgagccatggcatccgaaacaagcgtgtcctatcgagcttgctgcgacccggattagaacagaagccgatacggaagagcaccggacagggatatgaaacatacatcgaattccttgttaccggaagtaacatcgacagcgtaggtctgcaagcgagtggcgtacttggcagagggatgatcgataggatactacacgggttaggatcggaagagaccaggaccagatacggacttaccttcaaacagggagacttgaggctacgacacttgcggcaggacttggaccggagacctaccacggggtcagtatggaaccgacccggaagcggacggaaaacttaccggactggagaatacagcaggcggcgtgcccattggtagccatgctaccaacgcactgccagcaactggtcctaggatagcgaggaccggaaagggccagaggccgggccggagacgaggcggaggaggagggaacggactgggtctgcatggcggcagaagggcagagagcgagacaggacggaagaagtgtggaaacgatgcggagtaggatctgccccggatctcattcgtatcggagtcgatgcggaggaaggggggaacttacctgattatctggttgcacaaggaagaaagagaagaaaggaggaaaagaagtcggggggaagggaggtatttataggtgtgggagagggcgcgagtgatccgagtgatctgagaacccgcgaggaaaacgtaccggacaccaaaaagttacacgagcgatggcaaacacacaaggaatccgcatcgcagccgacccgaaccagtacaggaaccatacctccccaccctatgaccgaaaaagtcaaacggagaagaatacaacggcaaggaaccgaactggagccgtaccaaatgcgtacggggaacggatcggacaaacagaaaaccaaagacaacaaagaaatcctgcccagataactcccaaaaaggaaatcaaaatcaaaagaaataaggccaactaatcagataaccggaaaaataccccccaaattatttatttaagtccggctataagaagccgacctcgaggcggagccaaatcgcgtccgatacggacacgagtcaaagaccaccccgtctacaccaactggcaggtgagagccaagacagaaacacagcggacaaacaaaggaaggcgggaaactaggagccgtaccggtacctagacgaagccacgaaggaaacgagcagaacaaggttttttatcctgtataaaaggttttcccttgttagagattagatagagggactagagactagctagacctgcgagcgcgctccgtttttgctagtgtagtagaattggctctgacatggtagcaattcctgcgacgtaacaaacacacagagccctgcgttcgattctggggtgagaccgcaaaaatgtagtggtataagatctagcctgatcaactagacgccagctagcggaactccatgaggataagatcgtccgctataagacctgtttggcagttgtatagcgttgccaagcagaaggggtgtgttggtgtcagtgacaggctatatagtcaattgggcacagcaatcagcgcgagcgcgctccgtttttgctagtgtagtagaattggctctgacacactcacttcaataagcgaaccaaatattatatagtactatcaaacttagcatatacccaataaattccagcctgtttttatcaaacagaagcatccagttgaagaaacacaatacttctttgcagtttatccataactttaattacgtatatcctaaccacaccatttctactttaagagtccaatttttcactacaagatgcctatctcgtgatcatgattgctagttgagattcaataacctgtatcaaatcatttggctctaagatatttattggaagggagaaaagacaaaatggagttggaattcaaacgaatagcattaaagttgtatcagaaattgcaccaacattcccaaactacctagtactcaggcttcttgccttccttcagaagctccaaaacctcctgcaggaccttacccaattccacccccagtcctgcagcctcccaacgctcggcatcctccgggcttatcttccccagcggcatggagcgctccatggatcgcttgtcgatgaacagctccggcgccgtggtagccacgttcatccgcaggcccatcaagatctgcctcaagtgtccgccggccctgccaccgccccgcacgccgtaggtgacaatggcagccggcttcccggaccattcgtggtagagatagtcgagtgcgttcttgaggctggcggggacgctccagttgtactggggggtgacgaatatgaaggcgtcgaaatgcttggcggtggctgaccatttttgggtgtgctcgtgtgtgtagtgcggtgttgggtcatctcgaggcagctgggagggaactgcgggctcgttgtagagcggaagagactgttctgccaagtctaggagagccaaactggcatctttgtgatgactttcgagcagatcatagacggattgcgtgacgaaagggttgaggcgaggggacctcgtgctgcaagtgacaacagcaatccgatacatggtgtttataaagtgtaatgtcagtatgttgagtatataatagtagtaattggagtcgatggaatgattgggttactatacaagtcattactacgtctacctatttatactggagatatcatggaaatggaaggactggacagacgtcagaccggctcttgcggatattgcggcgggacattcaacactcaaatacgtatcaatacagattccgatatttagaatagtccgtccggcaatgagagccggcatgttggtagcggctcctgcgggggctttgcggatattgcggcatccttcactctaacggcgtggcactggctttgaacgtcgatttctcttcgacggtaccggctgtttctttcctcgtcatctcgtctcccgcaatatccgccatgcccagaagaacttctctggctgatcgccaaatcaccccttcaaaccggatgcgagcgtatgctgcgtgcaccgaatgcaggcgtcgtaagcgcaaatgcgacggggaaaggccatgttcatcctgcaagaattatggttacaaatgctccctcgcgtctacgagcgaagccaccccaggcggtggttccgtgtcctctcggccgacacctctcgataacactgcagccccatcacaagccatttcctctgaagaagtcgttgtcagcaaggaacggggacgtctggttaatgctcacagtgctgcggtatatccgtttcttgttggtcgggggctggatgctgcagagcctccaagactgcattcctacgcctggaatctcggtctccagccagaacggcgagggaccgttgacacccggctctcccaatacatcacactggacgaatgccggcagctttctgcggtgtatttcgagactgttcattccttcttctcgtttctacgcgaagatgatttcctgatgcgcatagaacagacctggtccaatctggaggaaagcaggataaatttcgctgccgtcatcgcaggagttgcggcactgggttctttcttctccagccgacgccatccgcaggaggagaacctcaagaaacactgcgtctccatccttgaactggcttattcgacacctgccagcgccattgacttagactctgtctctgggcagatcctcaggactttgtatgctcgactgaccactcggccggcagtggcctatttagcaagccataatgcaatgcacatggtagaaatcatgggcttgcatgccttgttctcggcaccaagcgcacataacctctcagagaagatcggcctcggtatcgaagagattagagaacggcgagtgatctactggacagcttcattcttggaccacttgctgagcatcgagtatgggatgatgccgatggctttgtctgtaatatcaagtgctcacacggcttcccgtgaagaatcacccaacgagtacattttgtcatctctcaccaaggctctagtctctatacaccaagcctcgaaagatccagcagggatgaaaatgatcgacgagacccttcaccgaattctccaagtaccggatatttggccaatagcctcgttattcaaggctgaagtgtgcctatgcctgctacggcagtcccccatcaacctcctagcgcgcaacggcaaccccgcgagcgttgcgatcctgaaaaaggccttgctggctatccctgagctcctgctcgccaggcaaccttggtggtgcttgtcaactgtcccgttccagaccgtttgtgtatgcttggcggcagacacacctctatacctatctcttttgcccgagagcatgagcgctctcagggccgttgttgacacctttgactcgcacatgacacaggaggcgttgaagacagcacagcagttgattgaggcatcgagggagaacaccatgtccaagctgtcgttcaaatcctcagcgttgggtgaagacccggcgacggtgaacacagaagctacgtggctacccgacgagcagaccccggatcttctgggaagctggcccctggacttggactttattccttattttgagtagggctcgagtaagagtgtaaatactaggtaggagctccgttggtgtccatcttatggcggagtggatagaaaggcaggatgtgacggtcacattcgacactggaattctttaatcgggcacacataatatcacatatcaagaagttcagtaccataataaaggcgtagtatttcagggtataataactagatggactcatctacactatatgctatgcagtgaaaaagggggaatctcataattatgatctcatgcaaaacatcaattacagtccgaaaccaacactctaaccagagagctagacacctccagcgtctttcctttcttatgcctcgacctgcttggaggcggcggtctcggtgggctggttctgtccgaggtactcggacttcttgagcatgttccacttgtcctcgtcggcgtcgaggtggcggaaggagaaccagaaaacaacaccaccgacgaaggcgatgcaggcgacggtggtgtagttccagacgaggagggggtcgccggagaggggcacaaaggcttggccgatagcggcggagacggcgctcatgaagaggttgacactcatgacgagggacttcatgttctcgggggccttggagaaggcgtactcgtacgaggtgacgttggtgaggatctcggcgataccgacgaggatgtaggggagggactgggcccagacgttgatgggggcggggggacaggtctcgcccgtcttgggggacttgccgtcggtgacgtaccagccgcagtcggggttcatctcgtagatgtagtactgcatgacggcggcggcgaccatggagagggcggcgacgatgaaaccggcggtcatgcgcttgatgggggtggcagagaggccgatcttgcggaggccggggtagaggaggtggtcgaagatggggaccatgatgacgatggagatggggttgaggttctggatgatatcgttggggacgccgtggagctccatggtgccggcctggatggtcaggttaccggtcatctggttgtaggcgaggaagaagacgggcaggaagaggaagaccttgcaggccatgagaccacggcggacttcgtcgacccaggcgtcatcgtaggtcatccaggcagggcgctcagcgacggggataccagagggcttggcgacatcccagtcgaacttgaaggccttggagcggctgcggacgaaccagaacatgcgcaggaacttggagagcagggagccggtggggggagtgagcttgtagttcttcttctgggaccagaggacgaagggggcagtgaggaacaggatggtggggatgaggaaggccagccagaagctgtgaagcttctcgacccagaccatggcgatctgtccagtgcaagaacccaggttgatacagaagtaaaagtacaggaagacacgggtgttggtcacagcggggtcaacaatgacacgctcgccgttgcgctcctcaacacgcatgcggctgtcgtcattctgctcggcaagcaggggggagacgttggccttgaagaaaccggtgccgacacataggcagagaagaccaatgatgaaggcagcgaaggctccgtcaggcttgacgatgacgtcggggatggaagagatgacgaggataacgtgggcaatggtagagataccaatggccaggtggagagtccagaaacgacccatgcgggcatcagcaatccaggcactgtcggcatgttagtcaatgaaacattttgatgtgatatggtaaagaggagtatttacccaagaagaggcatgaggtaggcgaagaactggttgaagagggtcaaagcctgggcggctctggcacccatgcccagagcaccgggcttgccatcgaggatgatgggagagccggtggtggatccatcggggagaggattcttgatgaagttggtgtacagcaccgaggatccgtagtaggagaaacgctcgcacagttctacgaaggcgatcgtccacatggaccacttgatggggccggagacacggcggagagtgcgcaggtcctcctccgtgggcttgtcgggccaccactcgtcgtcgtcggagctcgagttggcgtcatgggcctcgagcgtctccttaagggtctccttctcacgggagacatcaagggacctcttgccggggttgctgtgctcagggtcggccagaccggcacgggcgatgacgtccgtgtcgagattgacggcgttggtcatcttggcgacgttgttcagcgattctctacaagtgtcactttgtcgagaacagtgcagcgctgttgtcgttccctttggtggtcacctaggataggtgatagggcaggtattaataagggagcccagggatggggagaaagggatgaaggggaaggagaagacctcaacgaacgcgtcgagagaggacttaatatatacgacggactggactggtcccaggaggacggggggagggggggcaagaggggtctcacatgaagacggcagcacatgcaacacgatcagcgtgccatgctacaatcagcaggatgcctggcattgccgatgggattcccgctcgatgggaccatgacagagcttacaggatattagtttagagcgagataaggcaagggatgcgaccacacaaccgatgaggtgcaacgttctggggtgctcaaggttaagctctacagatacaccacgggccaagagtgaaaaggtctggctggatggggaaggtcgcccggaaggttgcaaaagaaccctgctcgctctccggatgcgtggccaagccaacaaccgtggtgggaccccggccgagacaatcgccaaaaaggttaaaagtccccaggccaatcacctggcggccgtcttggctttgggaccatgtttcggtccttttctcaaaggcccagtggggagcaggcgaggatgggggaccccgacgggctcttactgatgtggcgacgagattggggagaggctccgagcgagaggcagacattcggaggaccctgtttttgctttttccactttggcctcgatccagtgaaatggcagtaagacagtgatggctcgatgggccgtggtcagacacctggagatgcattccagagcgtgccccctgatccgcatgcagtggcacaaccctcccaaccgtttggcttgggcactgcatcccccatgatatccttggactgcctgcctggacggggtaagatcgaagatacaagatggtgatgtggtgcagcagaccatcttgccccctcgcttccatagcttcgtatcatcttctagaaggatggtgggcttctggtcctccacccatccacggccagctgcagactgatcgagactagtcgatcacccagaaatgcacagaatagaatacctagaacgggaagttgaacatcgccaccagagcgtggttgtgagatgccgtggccaggggagccccgaagagtttttctcagggcgatggcgcaatcgcagagcaactggcatcagatgcgatccatcagtttgaatcgaaccaccaccggatccgacaggcaatgtgcgagacagaacgccggggcattgcattccctcttacatgtacacagctagcaccaggccatggccgacctcacgcagagatctttcgtagcgcggctcccttcatcaaccagctcatgggccgggcaaactaaccttagtcaatcaagtccttctctagtgacggcgccaagatggaactttttctctcgggcttcgatgctccaccatccccatacattatcaacacgctacacatgtaaagttcccagtcagatcatgcttaagcttcagctgatgcttatcacattcgcagtgcaggacagcacagcacgcatacacacatacagcggcatgcaaaacaaagcatgtgggtgggtgtctctgtctgtgcgttgctgatcggtcgtccagccgcaccagcacacagccaatcagtccagtcccgcgatcccagcgagaggagggcttggctttgcctcttctgcttcttacagcacgagagcactgccctaaatgaggcatggtcaaacagtggctcgtcggctaccccatctcccacacagtagcccgcgggacaggatgggcgacatccccgaagcgggcgaacttttgcagagccgccatcgccaagcaatattttacttgtgtgtgtacttccagcaagattatgcgctgtaagatgctgaggaatcgcacgtcggtggcgccgcgtgtgtgctgaaggaggacctccgactgaccaacccaacaccaaggcacgctatctcaaccgccgtctggtctggacgagacaggtcagtccaggcaatgacggctgtggcgcatgattttcttctttcttttatttgagagaggcgatatcctcccgtgcagttgccgtgcttccatgaagctagcgcggcaaaagtgatcgtcctaattacactcatttccctccatcgcgcgcgcttgtggcaggttccgtgcgagacagtcgcaagcgtacagcagggcatcacaataacaagtggtagcagaacgatcaaccgattgtgccgtcgatgagtcctgggtgcaaccaaccaagacaggccccaatgtaagcataagcagtaacaacatgccgacgctcacacccaaaaactctcccaaagtgcgaatttgtcaagctcccctagctcggctccttcagtggacagtcgcaacgataatgcacaggcccctttgcgtgggaatgtaaccttccggatgcaaccatcgcccagagtcgaccagccgccattggctggtgatagactgctgacgctggcccttgtctcatccaatatgtactcccctactgtgaatgtgaatatcacttgtcctcttggccatgatttcccgactttgcccccgcattcacacccgatggcctcttgactgtcgcttctcaagcgccgagtcgggccctacctctcccgacatcccagcgaaaggggcaccattttagttaggggcactttggggggcgattcgagaatgcctgctattgatagtgggagttactatcatcgcactcaattgaaagtggccgcaaataaacccccctacacgggagagcacaaaatcgtgccggcctgcatggcaacgggcgccgtaccccgggatagcatgagtcctcctgcatgtccatcacagtccctttgtgccttcgtaagtagtgttgggcgtttaccttaccatcacattacgttttacgagatacattgccacgcgcttccccagaccccaaagccgtgccagagcgcaaagatcccccaagggtctaaattctggagtctgttacgtgaaagcgagatacagtttgtgccattacgtacaaaaatcggtccctttgtaaagacctggggaaattggtcttgacaccctgcagggactggccctctggctgagatcgaacacgaggaggcccatcttggtgatgtaggttcggccgcccaaattcagtaaattcggccacagtcggctacttgaggctcactcttttcacgtctgaacaacgggaggccttccttggcccccctcatctcaaccacggctccacggcgctcttttggtctcccacggcatgccaagggctgtctggattcccgatttgtcggctgattccgagtctcacgctaccaaagctgtccagctcaacacctcgagacacactgctgcaacggcgccggggtggcggagaaaacggtggaccaggccatgggttgtgtccttggcaatgaagcccccgcgcgccgccaaggacgcttgacaggtgatctctgggtacgctagcatcctggcgctgaaatgaatcagcatttactcgtcggttgttcagtctgccaaggcccaaaagttcgtccgtctccggagggagcatttctgaggatatatggatggccccatcgttgtgaagataccgaggccgaatagagcacaatttatgctttcattaaccatgaatccatccctcatgcgcagcagggattcctaataaacactattcactggggcggccgcgagggaggcgagaagcgagcatctttactcggataggcagcagactgtgaaggtcccgccagcacaaaccatccctgcaaatcccatttcattgtttgattcgcctcaggacatgcccctaaataagcccgcttattgcatgtggtggtgcaactgctcccaacacctggggtgtcccagtatttcccttgctttgagctggtggtcagcccatcagttcgtctgaatcgcaagggcatcaccccccaaatcgattgcttatcgatgcagatgatcaatcgttttattgccatggacgaacggcttgccagcctgtatgtccaggctctcacgtggttaagattgtcttgatcactgcagatgcttatttctaagtattcaggtgtttcaatctaaaggcgcatgcaaccttgacctgactttgaagagtgatgcaatgtaaaatgagattgtatcgagtgactgcccttctacctgcccgtactatagtatttcgacgacgcttctattgcatgtgtagacaaccaagacttgacccggagatatcggcaattcggcacgctgtagatgggagctgttatcattctagtaagaagcaggcctcgcgccatggatgtcatacatttgaaattggcaaaggcaacgctactagaaccgccctgtcgtattggtaatcctaagcagctactcctcctccaacagtcccatccaagagcgagttagcatctcttcatctatatcaggaccaaatcatatggcgagcgtgaaaaagccttcccttgcatgaaagctcaatcgtacattttagaagtcagcctacgcggttctttttcctcggtactgtgataaatcgaagttacgccagacccaaatatctacttcgcactcaccgaagagcattaagccaagagctgctaggctaaatatgtgactatcgagggggaagcccgaacccacaaatcagcttacacccgctgctacaaggttatcatatcccatcagtaagctaccgactttgttggtcgaaatattagtagaatatcgtaggtctgtttgcttgtctggcttttgcatgtctgtaaacaaaacattgggggttggatgctctctaggtagaggctactccgtagattgctactatctacgacggcctattttccaacgtcaattccgagcattgcagccttggcgtaagactcggcatttctatgccgggaaaagcaatgtcaagatcctctccacgtcaaacactcatgtcagtatcaatcatatttgcacgtagtagacgagttcagggtccaaccatccgagaattggcttcgtagagatatgactgcattgtctttatggaataaacattatgtggacttttttggtaaaccatatgaggattaattgtgaaggaaagtcataggttccttttacctattgtggacggtgtcactcgacttttttaatttggggttgaaatattgcatagcgggcaagtgttgggtgagatattctctgtttaaccttcaccatagccataactgtaacaacgattgaattttaaaccccccatgataggtttatgactaaaaacatcataaaggcaccagaagcatttcattattcgtgagcactgtctcatgtattgcggtgatctcggttactatagggtaggcccacgaggggaaccaactcgaatccaaccactttcaatagagttccttgatttatttgttattattagtcaaattgggaattaacaaaaaaagaggtaatacgtggaagatctacgcgtatttgctcacatctcccttttagatcctgccattagcgaagagtgcatgccgattgctggagtttcgcccacatcacaattctacaatgtgatacagcacttcagccctctgcaagaagcctatcaacgaatggtgagcaaaagatcgcatggaattcttggatataggttgtcgcgacgttgtaggaagtctgccttatctacgctgctcgaagcatgagtcaccataggctgaatatgattcattttggatcgtctagcggctctaatggtgatagttgcttttaggcaaggccattaagctctctagcgacatcctggacccctgtcgccttcgtggctggacaatggctgagtctggtgagctgagggagcgagctgaaaaatgcccctcaaataataatcaatcgtggcacgacatagtaagccaggtccgaggactcgagaataaatctctggcccgtgccggtcttctaaccatcaagagcgacatcctacacttcgcatcacagacattgatccaagatcaagatgcccgcaacgctgactatccggagtcaacatagcctggtccgcccaaagaaactgggtctcctgtatctccctgaagagatccagagcatcatctacgaatacctccttgtcgagaggacctcgctatgggacaaaaagcacgacatcgattgcaggaacaaggtcaccgccccgggccagtttgagatcccccctttcatcaacaacgaaatcctctccgccctcccgcacctcaccaacgatcattcgggcttcaaggcccgcgtggcatgcaaatgttccaagcgcaagagcttgggcctcatgcggacgtgcaaaaccatccgcgagatctcggctccaatcttctggtcaaggaacatcttctgcttccgcgacgccggcaagctggtcgcgaacctgaattcgctccggccatgttatcgtgagcttattagggagatcagcttcctggagcccgagtgcgccgatattatggccctcaatacctcttcgaaggggaacaagagtgctgcgctgtggagcgcgatcaagaaatgcgcggggcttcgccgacttgaactccctaccgactacatcaggccccagggcgtagacttcgcgcagcacctgaacgacttagcacggaatatgccgtacctcgaggcactgaacctgagctatcttgttggatacagcgattcgaccctttggttgatatgtcaatatccccagatgtgccgcctcacattcttgcactcctctcgttcagtaccactacgaccagaatggaagatagaagatgacgaatacctggagttggtccgagcgagcgaagacgatgaccaactattctggaaccgcagcatggtgcagaagctccacagcgacctgcatctcaactttcgggtccatgttgacacgtatgttcggctccgtattatgaagatttcgacttgggagctgcgccgcgggatacagagcctgtacctcccgcctgatttgcacgagcatgattcgacgcggaggatcagactgccgacaggcaagatgaccactatcaggttctatgggttgcccgtcagtaaagtgagcaggcttgagagggcacagaagaagatcgcgctggaccagcagcagaaggaaatcaacggattgactcacgctcagcaagttgtgaacaagagcctggaggcaaggaaatcgaggcagcgggcggcagagagccaagcggagtcgtctcagcatcaacagcttgtccaagagagggccgagcgaaggttggagaccaataaagaagaaaataaagaggtgaagaagaaggagaagaaagcgaagaagaaggttagaaagtcaatgaggaagggagaggaggtgaggcagcaggagagaaagagacttaaccaatgaatatctttagcactcgtatagagacacaaatccgaatttgattcggacttttttctagagatctatctttattaccagtcgagaaaaaaatcactgtcaaggaaagcgcttaactatcgtgagcgcagcctcatagaaagccagccttaccggagctcatacgatatcactggcgagccccctctttgataccgtacatcacctgttatatttctatacatcgtatcaccatcttcaatatacgcataatggtctgggcggcgaccctgtacagcatagctacttcatcaccaggctgcatgattgtcggcccaataccaatattcccttcccttgtgagacagactgttcgattgtaaaagtaaatctcaaatgtgttttgaaagaccatgatatcctgcatccgttgttgatcctcttccgtgggcagggactcaaccccatgttgatgagctaagtcggaaagagaacttgaaagcctccgttgattctctgtctcaaatcattcgggctcggacttcgaattcttcatgtttcgtagaatccagcttgatggttgcctattccgctaaatccttggtagattatgagttcgaacatttcgggcacccgcgaaggttactccgagttgggttctggttccttggcatgcctgacataggtgaagacatctgatcaagtagtgagtaggtcaacgtaaacagccgcaatatccttgttataattcggtatgagggcatccagaatacctatttggaggctaggtgaatgatcattgagataagcagttctaaattctagtaatagtaagaataatactatatttccatcatgagagcacgatagcgttaatagtaggaacttattttcttgaaaaattatctaaaccttgagaaaataatcttaaaatattccaaataataaatatcataatttgagaattaaaatatctaaaattattcttaactttaacattgccgtcgcgttcaatttcagaaattacttcaaggtaaggttttttgtcatgtttttttttggtgtgtgggctgtggcgtggtcgcaaacttttggccagttattttacgtatacatggatctcgatctttggaagtagagaggtgcttggaaggtggagatactgaaaatatgcaaaaccattgagccctcctctcaggtaacctgtggttgaggatttggtgttgctctggatttgaccgatgctggcgtaccatctccttgggcgtgaccctgcccttcgaacactttgggatataagtaatgtgaggacaatcttttgtgatggtttgtggtactgtagacatttttggcctagaggtcaaaatctgggggagcgaaatcccttctctttggccgcggcagtgacatccgcaaaccattgggtcttatcaagcatgagcacgacgtccatggtttgagtcctggctcgactccaaggcttgagggttcaagggctccagttccctgggctagcacaagggatagtgccagctgcaggccgtgaccagctggctaactgacccttggggtttgcatcaccgcgctttccgggccacggggggtgccgggcccctacagcgagtccctccgctgtaggaggaggaatccctaggtagtcctgctacggtaggcgggaggtgaccagctgaagggtcaactgggctgcctgaccctaggcctgagtcaggtgatgtggagggaaacatccgccgttggggcgggtgttgcaaatctttttggcccagccactcttttgaacctaagaactaatcagatatcgctttaaatgagagccacagcctcttcttagatatttatcgcatcttgaatccttaccctaaatcagaatcctaacttgaccttgtctggccctaaggatagcctacatagtactgtctgataccggctctgacttaacgccaataagcgccgggctggaatcaatagtccagcagattgggaatgcctatcactcgccaccagacgaaccggttacgcggcaccgtcagcttgcatagtgagagcagaagctgtcccatactgtgtaagcagccgacagggaggagctgaccaactcgtagtgcgagatattggagcaattctgcttgacgtaaggtactgtattgcgtaattgctcagcagtttcaaggttagttcttaagtattgtcacatcagatgagggaatgggaagatagttttgaatcggtgaaataagtggaatcgcctggggcagaaatatgcatacatatatacatagacaggacccattctaatgggaagcttgattttccaaaagaagaatgggttatgtcaatgcttgaagcacggactagtggagcggctacacgtgtaatgcttattcatgaaacgttctgtttccgcttacgattgcactctcaggcgtcagcaccgaacagggctgaaataggaggagccaggatctcggcactctcaaatatccagagggattttggagccttttgaacccagtgccggcacccgtcgaagatcagcactaaccctcaaccgatgagagatattcgtcagactggcgctatgtggaccacacttgttaaatccgaccaatctaactagtcttctccggccgtgagtgcactcctttgtttgtttcaaagcctaagaaaccagcaaaagagcgtcttgcttctaggaagggggaaaggctgatggtccggttaggataagggactcgtgacgagaagtcttccccttggtgcttcgtcaaggattgtgctgaataatttttcacaaggcaaccagcaatgaaacttaacatggggttacctggatgttgcttacaagaccttgtaactatgacccgtaatgaggcagattgcaggccctccgctccgaggacttgcagcaggctttctatttaagctagaatcggctgacgatgcataaccgcctgccctagcgtgtggatcagttcttgctgatttattaatcctgtccgtcctcgctgcctggggcattcgaaagtcatccctcctttgtgctgtgcacttcaggttgattcaaagccacagaagtacgaagccaccatggatcaattccacatcggctcgtggcaggactattcccagccggctggtgatcgggggagatttaccatgagcaagaacaatggcaatgtcttcctctcgttcttgactgtcttggtgacagttgcgggtgccagcgcctggaccatcgtctctctcatcatccacagctggattgtacgagcccgtcacaataacgacgtgttcgatgttcaacagcagatccttctccgaaacgcaaagaccccgctcgccaccgtcgccgaattcttcaagctctggcgcgcctggagaaagaagaaggttcccaatatcgccctccgcacactctgggttctcatccctactctattgctctacggcggcattctggtagcatccatcttcgcctccaaggtcgccatcaacaaagatggtggtggcatcgccctcgcacgggaccaaggctgtggaattctccccctctctggcacctaccccgacgtcgaacaagatatgatacgaaagaacaagattgtcaatgacaccatcgatggaagaaactatgctattaatttctacgacgtggatagcaccaccaggtccaagagtgttaggtcaacattcgtcacagatgctctgccatacaccgccaatttcaatgcgtcttgcccgttccagaaccagaccctctgtctcaaaggagcaactatcaactttgagtctggcgagctcaactctcacaccgagttcggaattaacgccaaagaacatgaccgaatatcgacacgagcgaaaacgacttgcaccatggtcaacctgaatggctattggaacgctactaacaatcaggtttacatttggatggggcagtcaggaacgggaaactggggctacacctatcgatataactatgccctgactaacttttctatcgggtatcagatagtgtgagtggaatggttgcttagtcttggcccctaaatcttgaacttggtccgatgctgatattagatttttagagacttcacagacagcaccttttatagcaacgactcggtcctgtggaatcgttacgacgaatttgcagttgaggacggcgacctcactctactcctaaactcccagaactggatgagatacagtgccccggtgaacgacccgttcttcctagccaatatcagggacccgagtgcctcaagcaggtacccttataagccaaactactcgatggtccctatggtttgcgttgattcatacatgatatgcaacccggagaaggaaaagtgttccccttgggctcgttatgcggacttttacgctaccgtgttcaacgataccaataatgacatgggcttcaacgatgcccaacttgccaccgcagcacgaatggccatccatatgcaacagacgaatatcaatacgatcgtcagcaacttgggctctgcctgtaggtttcatgcgccttatcccgctccaaccgatgctaacccttttctcagcgctttttgccagcgaccatgtctaccgcaatcacgagtcgacaggattgccagataatcaatggcacatcgaggctacgacatggttccagaccaaattggccaagttccaggccagcgtagccgaatacgtcagcaagccagacgatgcagtaggcctgccggtgctcaagcccaacgaccccaacaccaagaacgagtatgaagtcagcgacgaaatcctgaagaagctccaggatcagtgcaacagccagctgatcatgggcacggccgacatcgagagcttcagtctggcgggcacgctcgtgatcgtcatcatcacagtctttcttgccataatcagcatctacatcactgaaattatggacttcttcggccgcttcgtgcccggttccaagggtcatcttgcccgcgtggccgatgagaagctgcacgttctcaagcatgctctttcggtgcaggatggcccccagaaatgggatatcagggctggcgtgcctgtgacagaggacagccacggtggccagtggccgaaaacggatgttcagatgacggatgttcagatgacggatgtccaaatggcagatgctcaaatgacgtatgttcacatgacggatgctccaacgacgtatccgggtgcagacgaaaggctcatgtcgaagcaatatcccgagtttaggtaggagacgctgcctcgagcttggaataggtggacgaagattcggccgtgagtgctcgcttggaattataaatgaatagagccttgatattcgaacatgattaagaattatgcaacattgcttacgaaatgaattgcctatcccaactatagaaagtcttcagaataactatcttcttctacactgatatatggccgttgatactttcgaatcaatgctctatgaatatcgacataactttcaattgttaccattaatgctgactagtgagatcaaagacttggcccccaactcgtttatagccagccaataaacctcactgtttaaaggaacactgaacacactattgtttcagaaatgttgttcttgctccttgaacgagatgttgctgtgctctgttgctgattaagtcgatcaagcgagagctcagccgccccaatattaagtttccttggtcaaaataacctagcaaccgactccaaccaggacagagaatttagaatatgtgctctgatccaattccgataatgtagattccggtgggtaagtaaattgagcaagtgtctggtctgtcacgccaatgatcctttgtacactaggagcaaaaagggttgtagatcatatgccataaatcctccattgacttccaccgccaaatcaagccggcgctcattgaccacttttcggtcttgtcgaattcactgttgtctattgtagagattccatatttccacactcctgaaaccattgttctatctatcaccaaggagaagccatgccctcacctagcggcccttcgccgaagaagtatgacaatccacgacaacaatgcaatgatcgcgattccagcaatcccacccacaataggaccggcgatccaggcgagatttgtctgttttgacgggctgtcttgcgaaggcgtgtcagaggagaaacttgtttccctagaagttgatgttgtgactgtttctagggtggtggaatcgccctggtaacttgtcgattctaacgatgcactagtagtcgtctcccggtagtagtcccagggatcactggtagtgccacagccgatcattgtgagaggaacctcgtccttcaagttcgaattcacgtaatcccacgcgcagagaggggctgtctcggggctggtgtcacgcaatattagccatggttcttcactgcgtttacgatctccttcttcattactcgacataccaggtgacagtgctacgtggatataccggcatggaaccgctcacacaagtcgtcgcgattgctgtgcgcgtgtgactcatattcaggcaagctgcgtagctgccggatgacgagtagatgagttctggcgcacacgttatccgaacatctgggaagtttcatctggtcaactctaatctgaaaaatttggctcttttgacttacagctccccgtgctggagacatagcctatgaagttgggagcatattggtcaggagcttgcgtcgtggatgaagcctgttgggctacgggggttaacacaaggaatcctaatgtgaggatagtacaacaccattgttgcgctcggaaaaaatagtttctcattatgatgatctacacaagtcggtggagagaagccagcctccaaggggtagaacgatgagatgggaccaggctttacattatgcgtaatatgcatgcaatatgcctacgatcgttcgttgtctacccgccacatatccattacagccattgtcattggagtgtcactcatgcatactgataaaagcggtggaacttgaccaacgatagctcatatttgcggctgaaccaaccctctcatcttagcaagccactaggagctaacactacacgtctcacacgaaagtgaatagacttgtgtccgaagtctatggatcctaatatccctattggttggactatgtcgcttacgagtctcccctcagccgctgggatactgtgcattagcgtgtcgttgttttgatcacatggtcgcgtgcatttgtttcagccgtcttggcactgacatgcattctggcaaaggagagagtgagggcgagcggtcttgcgtattattcttagtgggcatttatcatgtacacaatcagaagaggcaaatcactgccaagggcggaagagtcgaacaataatctaaaactataccatttgataagggagtttcggaggaaagtcctatacacgtaggggtcgcaaattgagaagtatatgagccgagacaatgggacagattctaattaaatttcccctgatcgatagtgtaaagccgtgccttgacccccgtcatcattgacaagaaatatgatggcatctctctttccgggggaactatgacctcaatctcgaaagccatcactattcctgcaactatcttccacaccatcatttctgccaagtggcgacccgggcaagtcctagcacctccaccccaactaaggctgtgcatttccatttctttggcacgcccatcatccttcagccatctctcagggtcgaataagtcgggatttggcccacaaatgtcttcattacggtgaagcgcaatcgggttacacccaagagttgcccctgccggaatgtgataaccgtccaggcatagaccaggcgatggtactttacgtggaggggacattgagacgactgggtttagccgctgagactcttttataacagcctgcagatatggtaaactggatgcacttgcccatgaggcagtgccatctccaaagtgctgtctcagctcgattaccaggcgggcatacacattcgggtacaagccaagcattgtgatgagagaaataacggtcgatgccatggtctcatgcccagcaccgaagtttgtgatgatcatcttgcgcagatatgagtccgagaactcaggcttgtcgcggtgaagctgaatcaaatcctccgccagatcctggcatcccttttcgccccggtgaaatgcctttatccgcttagacactctcttattcacatcctacaagcaaatatgtgttagaatttcatatcaatatagcatagttctcggacactcactgggaagaatgcccgaaagttgggtggaggctggaaagtcaagttccaggcgttgccgaaaatcctcccaaatgacctatagcggagttgtagtttggcagcaagggggaatattccaaaaaccgccttgcgcctccagccttgatagctgtgagtgctcgtggcccagtcagtgttctttttcaacatgccaggagaccaggagagaacacttgctccgaggcattcgacaacggtgatgtgtacccattccttgaggtcgaattcgcgaccattcatctctcgaaaacgtgacaagacctggcctaaagctcggtcaatagaagcctcatgccttgctacatttgcagggcggtaaactgggccaataagtcgtctctgcatccggtatcgcttcatatctctttcagacaacagatctaaactgtcgactgagtgaacttgtagtttccaatcaactactggctttgaaagagttgtgcccactattcgccagaaaatgttgtcagagaccacctcacttataagaggaggattttactgcttacagtaaaaatcagacttctcgaatccgcttccattgcctgataaactgggtgttaggtggtcccacctgaggatatgttgtgatagtctgacgtactatagatagctttaaaggcagttttggtattaaaccagagctcgttggggcctacgcgtacgacaggtccgtactttctatgcagagatcttccaagggagacagcctgcccattccgtatttgcactgcataccacacgcttgagattgctgcgagccgtggtcctgggactgaagaaaacgggttgaagaaaagacggtaggcggcaatcgtaaggatcagtatcagagtcgatacaagggggtagataaaaaaagatttgacgaagaaccagacccacgagagaaggttgcggaccagcactatctcctccatagtggctggaacctggcgattttggtgtgccaagttcaggctgagcgaatgagaggtgaaccaagaaggagggaagaatcatcccaaaacacaccagaatagcttcacctgagtcgaccagccatacatggtgatagtgtggttctccactatcagatgatcgtaggcaaaacgtgcaaaatccttgtccaaatattgtggatttcactatgtgggatgcacgtgactcactatagacgaaccaagcccgactccggagcagctcaaccaccctttatctatcccctcttcttgctcgggaagccatccgtgcatcccggaccggttcatgtaaacatgggctggcctacttgatgtgtctggcgctattatatgcggtcaacctgtcaattttcactcaaataagaaattgctagcccctgaaatatcaagcaccatggcgaacactggtgatgagttccttctaaccggacatgcctatgtcaaaggcagagcttcagggacactggtggccagtaatctcgagttgagtttctgggggggtgtcaatcccctcacgggcgaaatcatcgatcggcaccatgacttgagcggaaagcatcttcgcggagccgtcttagccattcctgctggtcgtggctcctgctccgggagtacagccatgttggagctcattctcaatggaatgtgccctaatgcgatccttttcgaaaggcgtgaagatattcttacgttgggcgtgatgatcgcagaggagatatttggcaaaaacttgccagtgataactctcggcccggcaaaattcaaggagatcctcaaacaaaacggccgtttggtctacgtccaagatggtagtatatccgacaaggagctcccagaacctctgaacgtagagtctcgagatgatgatctacgctgtggggtgcagctctcaagtctcgatcacagcattcttcagggtgcctatggagaggcttccaaagtatcgatgcgtattattctacggatggccgagttgttaggagcacaggagctaatggatgttactcaagtgcatgtagacggatgtgtctatacaggtccaggctcgctagcattcgcggagagactccgtgacctcggaggcaaagtccgtgtacccaccactctcaactctatttccgttgaccaaaagcgatggcgcaaattgggggttgatccggcacctggcgaggccgctgaaaagctggggaaagcatacacagacatgggcgcccggcccacgtttacttgtgccccctatttgcttgatagcgcgcctaagctcggtgagcaaattgcttgggcagagtcaaatgctgttgtgtatgccaatagcgttctcggagcccggaccatgaagtatcccgattttctcgatatctccatcgcgctcactggccgagctcccaagggcggtccgcatgttgaagagaacagaaaggcttctttggttgtcaagctagggttctctttgacttcggttgatgatgctttctatccgttgctagggtaccaagtaggcatattgtccggtaaccgtatcccagccgttgttggcatcgactcactgaagccatcgaatgatgacctcaaggcattcggcgccagctttgcgactacatctagcgctccaatgtttcacatcgttggcgttactcctgaggcaccagatctagatgcagtcataggcgaaggccaaaacccccctcacttccaagtcgaactcgatgacttgattagttgttgggataagttgaacagtgcaatgaagaaccctcagcccgttgatctggtatctcttggtaacccacacttctcgttcgctgaggtgaggaagtttgccaaattatgccgcggccaagtgaagaacaaggatgtttctgtcgtgataacttgcggccgttcaacccattcattggcaagtcaggcagggctagtcaccgagctcgaggggtttggcgcccgcttcctcaacgatacctgttggtgcatgattgatgagcccatcgtctctagggccacatccaattctattatgacgaactcaggaaagtattctcattacggtccaggtatcacgggaagacatttttactttgatagtctagctggatgtgctgcggttgccattcggggtggccatggaggctcaaaacctctatggctgcgatgaattcataacagttctagagcttaatcatagataattgaacaagtttagtattacgcctattctttcatataacataaaatcccatttctatttcattgtcattcttcattagctatccagcatctatcttcttcctgtactgtcatttaccccttctcttcacgaagaaggagatgattcttcctctgcctccttcttcttctcaatctttatcctaagctctgccctccattttatccccctggctcttacgagaaaaagaaaaggggtaaaaacaagatacaatgctccgaagatggtaaaggtccatccagctcctattgcctcaatcatgggtataacagcagcactaaatccagctccaagaaggcacctcacaaagttgccagccgcagtcaccgtgcccggccgtcctggctgcacgtccacgagcaacgtgttggacgtgttattgtagcccaccatcccaagccccatgacgaccatgaggaagcagagcacagctaggtgagcgcgtgcctgtatcgcccaaccccagctgatgacgcccaagcccgctacaacgaggaggggggttccaacgtcaagtctggcacgctcaattgggaagtttgaaagatcgatttgcctggtgcggtcgaaggggatgcccgtcttatcacagtaataacgatatctccattgcatcaaccttccagcaatggctcccgtgatgatggatgagactgcgattggaaggaacatgaggccaactttcgtttgatttaagccataatcatttgtaagctgtgttggcagggcggcagagataccgtagaagccacctaaacaaatgctgcttgatacaaccaataaacaagtctccttttctgtaagcatcatgagtgagcccaggaaatttggcatctccaatttcagctttggtttcttcggttcctttgggagtgatcctgattctgtctcgtcgcttttctcagttctcttcttcatcgacttttggaaaagctgccatagtgtccggtgagtcacgggagccggtatcgatccatctccaacaattgtgcggcaggtttcagggaagaaggtcaacagaaggagaaacgttactcctgcaaggatggcgcagaaccagaaaatggagcgccatcccagatattgcgttaaaagacctcctataacgggccccagcgaaggggcaaggacgatcgggaggacggtgaaagctatgtaggagcctcgctcggcggatgtggcaacgtcagccactacggcagagcatagagctactgtagggctggatccagcagattggacgcagcgcagaccaaggactgcgccgtagctgggagcaagggctaagccgatgttggcggcaatgtagacgacgaagcagatgatgtaggctggccggcgaccccatccatcggcaagagagccgacaaacatgggaacaactccctggaagatcatgtacgtcgtgattgtcaagtttaccttggcgcttgatacttttagatcctcggcgatcgaagtcaaagcaggaagataaatctgggccgtcattggggagaagaaggctgtcagagccgcgcagaacacaatcgctcgtttctgccataatgtatatacagaaaacctgggctgtacgtcttcttcgggctgagagacggcagtctccacgtcatctgagcttttcccaccatcatctctcttggcctcgactgccaagactggttgcttgtcagttggtgctgctaccgactcggtcatcttgagtcaaggttagattctcttcgatcaaatcaatgtgaattgcgtcgctggagctatctagaagaggctgagaagtccttctagatatatgacatacatctgattcgcgtcacttcagcttcagggaacgggagcgggaacggagtttatgtcaagttgcagccccgcagagttcccttatgtaccatatccggagcctatgaaagcactggagttgtaggggtcatttcacctaaaccatcgtcgttagagctctgcggcagaatgatcgattgttacgctgcctttgccggtgccgatccggtgccgaatcggcactcgatctagagtcccatctttttctcaacaacttgagtagattctaccaaactatttggttcactgttttagccctattctctcatttaattatttgcgtgctggtttgtgttgttttaatcaaaaactcgttcctatataatactatcaaccatccagcctccctccattacaccgcaattcggcttgagcacagtttggccctcaagccttcgagcaatatttgctcattcgacaccttaaatttccgcctccttccaatcctccaggtggttaaaaccactaaacgacaagggccttcgtgaagtgtcatatatatggtgaagacgatggcccaatacaaaattatacaaacccatgcacgtgagccataactgagaaaattgtgaagtccattcgataaagtgctcacatattggtattttcaattttcgtgtatcgaaaggctctaagagaaatgaagcagcagttccatggatatcgtcaacatctgcatagaccagctgaaagtactcaaagatttcgtttggagcgtctccgagcgaaacccactctcccagctctctacaatccatgttcaatatccgacgagccggccacatgttcacaaattccttcttcgcggttttataaccgaaaaccatctgagggtgacagaaaaggacacaagtgaattcgccctggtaacacagccttgcctgtatagccccattatcgaaacgggagatgcctcctacttctactatgtggactgcaatctagacgctgtgccctccatactgagaggagcgtcaccaaacttggcgcatgtcatcaggggtccatgaatgtctggggccattgaagagctcctagcaccgtaacggtcaatctggtcgggtttcccagcaaagacttccccatcccacctgcagaattgagggaaaagacagctacaaagcctgaattttaactgtgtaccagtaacaccagactttgtcgcccaataagctgattatactgagttcagcgagctgcagttgctggaattcaaaactattaccaccgcgacgatccaacaacgatgtgctaggtgtcctgctcttactacaattaaggcaattatgtacgagcccatttcgcctgttcactcctttgtttgaatgtctctgaacatagcatatgcattgaagatgtcccacgagcaggtacaggtaaatttaatagtattattagatgacatattccctcaccctgatctaatagttcgacgcaagtgaatcatcaatgattgttcacctcaatgttctccaattgaaatggtttcacactccaagtttcacttatctatgacataccatcaagaccattcatcattacctcgacaatctttcccccgttgccggtcgcttgtctcatatatctccaatgttgctagcgatgttccttcgagttacccatcttcttcttacccaaagcctaggtatctcccgagatccctgctgggtacactgaaggaaaatgaagtggatcaatcacaagagtatacctctgaacgcttttaaagtcaataacgcggcaatctcgagcttaattgtctcgccactgtctggaaccctgaaggcggcatgtaccatgagagctgagccgagggatgaccatcactgtgcgaagaaatcattgagaggatatcgtggtacagtcaaactgaaatgccaagagtttcacctcaagcagtctacccagagagcggtaggccgctaattgaccctgtgccctcttgccttgtatcctagggcaataggctctcactctttgagccagatacacttttgcgcgatgtctcgtgccacgctagttagaaagtctacccattgatacatttaatattaaggcaaaagattaagtgccaagagactcgccgtgtggcggctcataaaagcttgtctcggtccactagacgattgtttgaattgaggttttgtaatggcttggggtctgttgctaggcctgggtcttcttctgagcccccactgtaatcactatattagaatccaagaatgatgcgaatacctcaacgtgtcctttgaaagactttaaatgtctgcctgcaatgaaccgggtagtcgtcatctgtcatgacatgcatagtgaagaacaggttgagtcaattgtgacaccactcttgtcctcaccgttgttagtgaccgatttacacaaattttaggccatcaataagcaaataaatacttcgttctcatgattaaaaaaatccagatcaggagcaataaaataaaaagcacatttggatttgcaaagctggaacagagattaaaggtatagggtagttgtgtgcactggtgggcgtggcacttacaggcattattagtgggccacgtatagcgccagttcacgcaataagtccaccatcccgtccgtcaacatccacgttgcagaaacatgtgaaggacttttgttaagtaggattgatttctgctcccgtcccatttcgacgttgctcctctcctacgtcctccagcattctctataaaaccatggtaagcaatcagactcaagttacccccagtgcaatggcatgcccgacgtcgctcccctgggcttgctttgtttcaatctgccagaatgctaatgatgccacctcgcctgtagaacgtcgcctacaacacggccctgcgccaaagcaaggccatccgcgccgagctcacgaacctctcctccaagcaggcaccctctcctgccgaaattggaaacgtctccgcctccctcgccaccttcaccaagtccatcgacgagtacaacgcgctggcccgccaggagattgtccccaagaagcaagaagaagccatcgagcgcgtccgcaaattccgcgaagacctctcgtccttccgttccgacatagatgtcctcaaaaagacccgtgacgacgccctgcatcaggccaaccgatccgagctcctggggaaccgccggccctaccaagcctcctccacccccgagaatccatacgcacaccagccacaaaccccacgctcgccgggccagcaacagtatctttccacaggctctggtgacgtgacccgcgaatcccacgctctccgtgagcaaaacttctttgccaccaccaattcagccctcgacgactacattgctcgtggacaggccgtcctcagcgaccttggccaccagcgtgaggtgctcaagggaacccagaagcgactctacagcgtagccaacactctgggtgtgagcggcgacaccatccgtatggtcgagaggagagcgagggaggacaaatggatcttcctcggtggtgtcatcatcttcttcctcttctgctggctcgtcctccacttcctacggtgatcgaagcgaacacgaccgatacgatggaacaggaacagcaaaaggacacattcacggcggcggcatggagcttttgatttgatagcatggcaccagaattgggggaagaaaactccctacagagggccatgagcacggacatgactatttctcacaacttttataccacaagcgtcattcttctctcgaacctttcttttattcattattttcctatcttggttgataaataccctcgcctttaccctcttcgctgtacatgcaacggggaccaacttgccctgttcccgctgcacacctactccctccacccgtcattctcgccgtcaatatgcttcaaagctatcgtgaacaagacgtccttgtccgtctccacctgcacccagcgcgtgtccgggagcacatggttgctcgtgctcaggttgccccccatctgcgtctcccagtccgtcacgtcccactcgagccccttggtcgagatccggctcggctccttgagcgggatgatgccgacgtgcttgccgaagacggcctcctcgccgtcctcgcggacctggatccgatgcgaccccgccttaaggaggaacgtcagactcgaccccgagagcaggaagatgcgcccgtcgccgtaggtgcggtcctgctggaacaggtacaggtggtggagctggctgagcccctggtcgacgcggccgccgatgccgccgagggcgacgatgtcgatcccggtcgggtacttgtcgcgcacgtgcttgatggccttgccgaagtcggtcgagtactgggacgagtcgtggatgatttgggcgggcgtcggctgggaagtatagaagtcgcggacggaggggttgagggaatcgaggtctccgatgatgacctggaggttagactgggattcggtggacaacgcttagctgtaatgctttctgcatgtttggatggcgcaaaggtatgcaggtaggacaagctctctggtatgacaggtagaaaaaaaacacattttacggatcactcacgaatttgccctcgaaagaggagaggtccttcaggcgattcgcacctccgtctgctgcgacccgaattgaagctgtgtaaaatgcaacctacgtcagtcttgagcttctcaggagccagggtattgctgtgaatgttagctgctgggatagaattctctcgtacagtttctccagagtctgcgtagattggcgccattgcgcaagggctggttgaggacgacgagcgcaaacgcgggcgcagtctcgcggctttgcagcagcttggcgggataccactctatcgcggtcggagtcgcatcagaggccattttgacgtcagtacagtgggatcggcaaaagggcaaagaagacgccgcactgcgtcagaacaaaggaagaagggggggaggctaggtcaagcgggcaagaagagaagaaaaaaatgggtggacagaaaggctaagtgcagttgagcatctgcgctgagctgcggcgcaccgtccaaagtctcgatgcccctcgtagccgcaggtacagagagtctgcgatttagaggtagcagccgatgcaagcggtcggccctgttgctgcacgttcagtttatttccaggattgagatattttcgaaagactctctttcgaaaagcccaaaccccgcttctacacgggttccagttgacgagccacacgtctgcgtgctaccgatggttgcctccgtgatcctctgtcaggtgttgcatgtactagccaccgaaacacagaacgagagatcgcagctccaggtagagagtgtggcagggcagacccgatgctcacaagcatgtggcacccttgttacatgatcgacatcaagagcactcttctcaacaagaaatcatcccccatggcccagctggctaaggcgtccgactgttattcactaacgcaatcgggagatcgacagttcgatcctgtctgggggagttcttctttttgacttttttttgtatcttgcactcttcggataaactctggcactagctgctaatctgatgatgtcggtattggtgcttaccaaccagcccgtgaaaaccctcaggtcaattaccggcaacttttctgtcccatccgcgaagccggtgatcaaacgtcactaatccgccctccttctcttcttccacttgtcttaattacttggcttcactcaattagctcccttttgttcggagaacgtaataaggcaaaaaaaaaaaaattacataaacgaagacacaatgtatcgcacagctctacgaacggcctcaaggccagccctacgctgcatgcgcctccagggacagacagccaccaagcgattcgcctcaacgtcaaagcccgcagacaagcccaggagttggaagagctcagccctccgatggggtctggccggcggtgccatctactactactccaccaactcgctcttcgccgacgacgcagccagtacgtatccccaggaaaaactgaccatgtcggtgtcgcgtcctcaggaccacgctaataggaggctgcgaattatagctcaagccaagacgatccccgaaccccctcaattcgccgagtccgatctccccaccgtcgattccgtcctcgaggagaagcgcaggcagatccaggccaagatcgagaaggaagctcccgtgcccacgtccagccaggaacccggccccgatgccgcaccagtaggcgccgagggcgaggctcccgcggacggggagggggccggacagcaggcggcgttcaacccggagactggcgagatcaactgggactgcccctgcctgggcggcatggcccacggaccctgcggggaggagttcaagacggcgttcagctgcttcgtcttctcagagacggaccccaagggcatggactgcattgacaagttccagtacgggattccccccccccaacacatctcaagacttttgttcgtcattcatcagctaacctgtctctttccttaggggcatgcaaacttgcttcaagcagtaccccgagatctacggcgcagagctgaccgatgatggcgacgacgacggcgaagacaccgccgctgttcccgcagatgctcccccgaacaccgagggcgcacccgccgccaaagccgagacaaaggaaactcctgtcgagacctcaacccagaccccagccgccgacgctgcccccgcccctaaggaggaagtcaagccagtggccaaggaggagcaaaaggtagaagccaagaaggaggaggctcccgcaccttcaccccgcgtagttgagcctcccgcgcccgcatgggaagacgcccgtggggctaacacagagggcgacaagcaataaacacaaaaaaggatatttgaaggagtattggtttcacagatggcggaagagctgtcgggaacccacgaaaaaaggacttcgtgacgatgttttaagaattttcaaaaactacaatatgtacattatacgcgggctcccccccctaccacggatggcggggagcggcctgtactaaaaccctgtacactgatgatactgcataattacaatggcgcagagaggtatagaaagaaatagacgactcacaactcttctatgactgtggttgacggacctcgattgttcttttgtttgtttaacgcttcacatcaaattatggcttggttccaagatcaagtgatggggaaaaaaataggcgagtatttaacattatcgcaactatcatactacacaaatcggtatcaagcaatacacagggaaaagacaaagtatcctccgaatgtttctcgccggttaaatcgccgtagacgccatgaacgaataatggagaagtgagacaagaaggaccacgccaactagaaaatctccagtcggtctccaatccatcttaagagaggtgaagatgcaaggaagggcaagaaaagtcattcttctttacgaagatccgtccttcttggtcttgtacagataccgcccgacaacgctctcgacggcacccacgcccgcgacgacgccagcgccaatcccgatgtccttccacgacaggctgccgcgctggtagaggccccaggccttgtacccgaggaacgcgctgatgcccactacggtagcgaggttgacggcggcgacggctcccgcctcgctatcggagaggcgggcgaactgggcctgcagccagctgtcggccgacttcacctgtttcctggccttggccttcttggaggcggcggcggcggcggcagcctcctcctcgcgctcgaggcgggcggcctgggtctccgtctggatctcctgctcgaggaagtcggcggggacggtgtggacgctggggaggtcgacgtcgatgagggacgctgtggaggcggactcgtcggtgatgacctgggggggttgaggggcagcagcctggcggggcggttagatggcaaatctcgactgatggcgaggtagggcggcgatctgatggataacgtcgcggggatggaaaagtgagaatgggatttcatgctatcggtacatacctcttcagggctctgcttggggccagaagcagcaacgtcggcgtaagacactggatggtattagcagagcaatggaaagcaggtactgggagaatatcttactggttgtagatgggttgggcaaagtgagatgtgaaaatttggaggagagggtgcgggatggattggaattggagggatggagggtagatgtgcgtgttgagaaaccaagaaccagtacttgcggcagatatatgcccagatagcagacagggctagatcgtgtgatgacggaagagcggctgattcgcacggaggctgtaggagaagccagtcgagtcgagcacgctacaagtcgctgtacctgccggccgagctgctcctcctctgccctttccctcttcctgctcgtgctcttgccaattgcgctcccgaagttggtatcaatgacgtagccaaaccccacctgcacctgtgcccaaccaccaatagcggcttttctgcttctccatcgcgatgcgttccgaggctaccctatgtcgagtctgtctctgcttcctctcgtatgctacccaaggtacttgtctgccagagcccattctcgtgtgtgtctcgaagtttgctcgcgtgcaacccaatcgcccatttagtatgccccctcctgcacgaatggagtgatgccatgggatcacagtcacttcttcacttcgctgtcatgtgcaaatatgccgttaggtggggctcgagcctagttagtggacctccccctctgttgtccactgccgcgatcagcaattgttaatcgaatcgggtccgagtcaggcaacgacacgcaccaactggaggggaaaataacgggctcaggcacaggaaaaaccaccctacgagatatcggtgagtgtgcgtcgggaaattgcgtagcggcgatgggagtctagagatggtcggttggcgattgacccttgtgttggtctttgccatgctggcgggccccgcgtatgcattgaggccagggcttgggcagcagatggagatggaatattctagctagggcaattgtttttgcgagctatcgaccctgttcctgagatggctttgaatctgggatcatccagggagcagttgcgtcatttcaatttattaggggtagcaacggttacggtgaccgaacccctggtggcagatcatgatgacacgaaatgcagctcacacagtgaaaaaccaaggccctagtttggatggaaccctccgaaagatgtcttcttccttggctgctccattctttgcagttcagtttctacaaacatccattataattaacaataatcaaatccatactgacaccaagctttgtgcttcataatacgtcctgatgactccccccgtttccaaaagcactttccttgttaaaacgcccttcccctgtccatgggtatcaaaaagttcaatctctcccccctcatctggtgtttttctcccgctcgtctttctcgttttgcttgggtcccccttcattgaaaataacactcccaatcgcctggcacacaggccgtaaatgcaacatgttcccatcaagcctcgcatccctatgccgccccgtcatggtgggttaaaccgaacacgatggaatatatatagtggtacaaaattgtgtgcccagttgaaaaaagggagacgccgaaaaggataaaaaaaaaagccagggtaacaaaataaaggcttcgccaaacattcgcgcgcgtgaaatatgctcctggtacaacctccccgctcgccactatgatgtcttattcagctggtgcatctcgcggaacttgccaacccagtgctgccgaacgtttctcggcatcttgcaaaataccatggctttgttctcgatgctgagcacgttctcagaaatcttaacctgcaggtcgagctcttcctcggagaactcctggaagaagatgtctagcgcctgctcccgccatcgcggggctgcccgtgtcctgagagcctccaggagttcctctatcaagggtagttgggcacttgacgcggtctgctgcatatggctaccccctaatgtgggcggtacggaagggacagctgtggatggcgcaagaaggtcttgtccgctcgttcgccgccgcttctctgacgggattgcactgcttgagggtgccgcagctgatcctcccaatgctggcgctgtcccagccaatggcggtgatccggtcgaatcgggctgtctcctcttccgtcccagctgaacctggccagtcaatgtctcgtctggaggtgttaatgcgcttgatgtggctggtgttaccactgtcggtaatggtaccgctcccgtcggggcctgcacctgcgcctgctgctgtcccatcgatccgttcgacgatcctgtaggagtttggctgagtgtcggtctctgctgctgcacaccgttcgacgtggtgccatcccccggggactttgcgcttccttgcaagtttagcacgcatgttcccggcatctctccgtcgtcggcaggtgctccgtctgtccgccgccgtggcttcattattcttttcggcgcaccgcccgagcctatcacgtctggatataaaatctccatgaaatcttcgtggtcgaacggccggcctcgcaaggctcgagaaaggggttctttctaaaaatacagcactgcgtaagtcaatgggatccatattcgatattcgttttaagaaacaacgaaagcacaagcgagaagctgaattgaaagggaaacctgggagaaactcagaaaattaggccgtacctcaatatgtgccttccacgcgtcttccgtggccgtcaccgtcctcataattggatcgtacataaactcgggatcctcgcgcagccctctccagagacggaatctcttacgtgcgttgtcgctcttgttgatcaggtggctcttggctgggtaggcgccgtgcgtagcctggagggcctgggcggcccgctcccacgcctcggctttgaaactgctattctcgcgcaggccgagctggacgctctcgcataggcttcggaagaaggtcgtctcgtaggatggggtccagctgaagcgcggcgctcggcggtcgcggtcaatgcgtacggggttgaccgggccatccgccccaatgttgtcgatgtcgtcttcagacatcgctctgtgctcgtcgctctcgtccttccggttgctcccaggcgtgtaccaggcgtctcgaaaagagtgtttcgttcccttggtattccaccaaaagagatcacgagtctttgctggccagatagcgtcgggtttggggcgaatcggagaactaaccccagacctcgaagccggtccctaagggcaaagtttatcccacggcccaggtgtagcgccgagacgtgtggatactggactgttattgtgtttatgtgttttcatgtataaaacttgtcgtgcccaggcaactgcacagtacagacgatggtagactgcgggaatgatgggctcaggtcctggacggtcggacaatggtggtcgcggccattgcttgcttggggttcgctcggggtggaagtgtaatttttgtcgtcccgttctgggttcctggaacacccccaaaggagcgcgtgaaccaaaaaccaagaggagcaggtcgacgcctcgtcgcgggatgggcacaagggaaacgagcgtcggaaatcggacgaaggaagcggcgtagatatcggacgggtttcgaggtggcaggctccgccaaaatgggtgaaggtcggagcggtgatggcgggtggaaagtataaagggtagtaggggaccctgcgattacggaagctggaggcgaggaggagattggggtgccgcgatggggtgccgcgaacgagcttgtatcgaagtgaggcagagcgggagagatatttgggctgtgaaggatgcgcctggtgtttggctccgtgtgcgacgatggaggtacctggccagcgggcgggaaacacggtcgcggtcaggtatcgacgctgcagttaggagctgaagctgaggcttgcttggtgcgcctatcgaggtacatggaggtacaccgtacatggcaggtacggctgggcccagggtctgcggaagcaacaacgggcctgtgattggcagaggagcgtggagtccccgcttgaaacaattttttgacgcgtcacgtggatgatctggtggacccgtaatcccgcctagcctcccgagtgaggtagcaggtacatgcaatggaaccaatattaatttgataaacgatgaccaacaggtgcgtgccgtagctgcaatatggctgcagaccgctgtaatgagttcccgaaagctcctgctgtctgcgacctcaaaacatacaattctagatggcctgtgttgcttgctgtgattctcatgtcgcatctcgtcgctgttagtccccttatgccgcaagtcaggcagcagtttaacgagagcggagcaagtaccgtgcaggtacctcgcggaccctgaaagtgatgcgccgctgacttagtgggtgcatgcatgggggatctgccaccaccaagtaccgcagcggtacatttaagtatgctcccagatgacggcttttctgcaacagagtcttgtgatatcgccagagtgataaaatccctgtccagggcagagctccccactgatagcgcgggatgtgacgctgttgtgatgcggtgtggtcagtgggctggcattggtaatgcgcgcctaacaataataacgagaatgacagaggacgagccataattatagctcacccgcatcgtaagtaagtacggcatattcctctggacaaaagaatccccagtttgtgggacttagagtcgttatattaatatgatccatgcatcgtgacctgcgagccttcggttcctatgtgatcaggttctgccttccctcgatcatcttctctcagcacctgcctacgagagcttcaaaaattcctcccacttggtctctgtcggatcacatctgcctcgtatcttgctacctttgccaagcaatcgccgatactgacattaacccgataggcgagacgcttgtccgttgggctcgttcaatgtgcgcctgagcttcatggatggacgtggcgcaccctctgaaacgtcaaagcatcgtctctgcgctgccgcccgacgagaattaaaacattgggagcagagcaatcatgcagtcggcggacaatcgagtcactggaccaaatcaattcccagactagtaatatgtacaataggttttggctcgagcaacaattagcattatccccatacgtgatcaaccaactccaatcaggccattattctgccggatgttcgtgctcgtcttccccaatcacgtctaatatctacagttttccctctcccttctaaaggagcgcaacgaggccagcggcgaccatgacggggatgcttccaccaagggcggcagccgcgccagtatccgtggcctgagcggaggccgatgtcgatgtagcgctgctgccacctgatgcgctgctgccggtgggagtggctgctgctgatgaagggacggagctgccggtcgcagagctgccggtagcactggaaccgctggcggtggccgtggcagaggccagagaggaggcggcagagcagaagtcaatggcggcggggagcactttttctacaaggccatgattgttagcggattcatcgagtggttcagctcgtccgtggtcccattgagctgggctcaggaaaacagacagctccaacatattgcttggaaatgcatcacgtaccgacggagacaccagcaccacaggcggccatcacgcaagagacggcagcgtcgtagatggcctcatagttggactgcacgcaccagcacacggcatcggtgagactgcagtcggtggccttcttggtgccgtcgttcaggcagttgagggagcactcggggaagtaatcctccttcttctgaccggagacaaggctgagggcagccacgatgaggatagaagccttcatgatggatggatgagagtgctgcttggatggacacgtgagtcaaagcaattgagtgatgattcagccttgtacgcaaaccagcgggaacgagaagaggaatgacctgccctggttttatggggagcgaggcaaaataagactcttctcaacgatgctatgggcaaccgcaacggcacctacgggagagggatggggcgggaaggcaataatcagacaagccatcagtccaacaatcttatcaaatggggacatccatctccatcgccttcagctcgttcacgtcatgcctaatccaggtcttgggctgccccgttcaggtcagaatgacctcggcttgttgcttggcaaaccgccaacgcaggttcgcattgcgccaagtccaaaagaaagagacgcatcgctcggcacatcggaagctcgcggcgtgatttgagcagtcaacaggcctcgttgcagactagttctttcttctctcactctcgcaacatgtgacaggcttcctagacgaaacacctgccttgtccgaaatcgctctcacatccaacgagggtggcggactgggatgggtgccgggaagggactttgtctgccatcttcatttccatgccagctgctcgattcagctcgagggagctagcccgcattaacggctcttgctgatccgacggaccatccaggagtctcgattcaagtgtgggtggagaagactgaagagataaaattttatcagatcatcagataagacgggatcattggtcttggcgcgtctgggtctccatctggaccatccccattcgatctaatctcgcctgtttgcccctagtttctctgcaactcatctgttccagcatgggttgaccagctttacgacctggccattagtcactggccatggcggcctgtgagactcgcttccgctcgcctgaacctactgcttgtttgggaaactgagctcccctggcagctccattgtccggaaccccctgttgagactctggtgtttgccaacgcctctgccaatgcccgagccctgaactactgctctgccctacggtgaactgaccctacatgacccggttggttcccagctgctgtcccttccctgtctttgcaggtcattcttcgatattccgagagccgatcgcggttggatattcgcgcactcctggacctttcggatctagcaccaccagctgactgtggtttttttccctctctattctttcaccagcttagtccattcgtaacattacccagcaaatagtgccgccctccgtccccctaatggcgatttagtcaagtcgtgtttgatccatgctcgtaaatctcggcaggggcgccatgccgcgagtataatatacacacccgtgccggatcgactacaaccttgttggccgtttcttctcaaaggaccctaggagcctcggcagcccttgtcgttagttgacccgatacgcagcgcctgcaatcggtccacacgagcgcacgcaccatttcagtgccgtgcctcctcttccatctctgaatttttcatcctaatcatccatcacctacttggagtcttacgctgcgccagcccacttggataagatgggcttgctgaacttcagcaagaagaaggccgaggtcactgaggttgccgagcagcctcagcctgcctctgtcgacaaagatggtaaccatgagtcgaacatatccgaagagaaggggcccaagggtgatggtaccgtcccggaggcaggaggaaactaccagtctggtgttcaggcaatggaggccgtcaccacggtatggacgaagaagcacatcgccatcgcatacggcatgtaagttctcgatctatcttggatcttgacaatgcaattcaagaaacgagttccggggaatccgggatgctgactgactctccaggatctggctcatctacttcgtcatttcgatccaggaggtcgtcctccgagcgctcaacccctttgtcgtcagtgacttctcgaggcactctctgacgccggttgtcaccatcatttccagcatcgttggtggcctttctaagctgccgatcggcaaaattctcgatacctggggccgtccccagggtctggcactgacccttctcttttgggtcatgggtatcatcatgatggctgcttgcaggaatgtcgagacctacgccgctgctcaggttttctcttccgttgggtaagctgagcatactttgttgcgtttaatcctccttcaaatactcacgatcgattgtagagcccaaggtgtcagctactgtttgaccatcttcatcgcagatacctcgtctctgcttaaccgttccttgatgcttgcctttgcgtcctcgccttatatcgtcacgccctggattggtgggcctgtctcagacagaatcattgctggtatcggatggcgctggggattcggcatttggaccatcatcacgcctgttatcgtcatcccacttcccctactgttcttctacatgaacagacaggcccgcaaagccggcgtccttcccaaggagtctaagcccctgaccttccaagcagtcaaggacttcatcatccagttcgacgtccttggtctccttatccttgcaaccggcatgtccctcttactcctctccttctccatctactcctaccaggcggaacagtggcgttcagccctgatcatctgcttcctgatcttcggcgtcgttctcatcggtctctttatcctctacgagatatacctcgcccccgtcaagttcattccaatgaacctactggccgaccgcaccgtcctcttcggcggcatcatgttcaccttcatcttcgccaactccgccatctggggctcctacttcacctccatgctcatggttgtctggaacaccggcgttgagaaggccacctacatctccaacatctaccgcgtcggctcctgcttctccggcctcgtcctcggttacgccgtcaggtacaccggccgcttcaagtgggtcgcctgctactttgccatccccctcatgatgctcggtgttggcctcatgatcaagttccgccagccggaggagaacctcggatacatcgtcatgacgcagatcttcgtagccttcgccggtgggcccatcgtgcttgccggagagatggctatgatgacgccccttgagcatcagcatgttgcggccatcatcgctatcctcgacctcttctccagtattggtaccgccgttggctccactgttgccgctgctatctggaccggtaccttcaaggacgctcttaggagacatctccccagtgagaagttggttgatagcatctacgggagtttgtatacccaactggcttataagccgggcactgagatccgccatggcatctctcttgcctatggcgagtctcagcgatacatgcttattactagcgtgtgcctcatcgctggtgggttgctgagctctttcttgtggagggatatttccctcaagaacctcaagcaggtcagaggaaacgttgtctaagatgggaggcacttgggcgacgatagatattgtaatattggtgtggggtaaacttcgcgtttctggggatcccttaaataagagatactagattcgaactactgaaaacaggagggaacggaaagggttgcttgtggactttgaggatggagtccattggatgatttatttgactatgtaaggccaatgttatatgtaatagcttatataaagtagagttggaattgtgtgcataatcaagttaaggaacctacctggctgggcttctagactttatctccgaagtagtggaagcctgttggattgggtgacaactgccagatcatgtttagatgtgatacctaactcagatctgtgaccaagatgcgttgggtgtcaatcctgtaaaccgcatgaaggtgtttcagttttggctgatgcggctaacgcttacagacttgtcttggttctacatgctcctgaggaaacatccggccagtgacgggcaagtacattgctcaggattgctctgcgtatcatgtggaatcaacatactttttctctggcaggcctgtagtattcccggactacttagaccgagggcgaaatcttcggatggtcttaagttgagccggctgagtgcggggaggaggcccatttctcccctgtcttgtgggctgaagaccgagtcgtcataaaggtgaaacagacgtttgattgtgctgacgcatattcattgacagggcggtgatgacgtaggatcttgcctagatgcctaagcctcacgaatcccataagctgactttaatccgggacaatttttgggatgttttacagtaaatccaaccaattggatttgcgcgctatatttttatgccagaatgtgagtcgcagcaatgagaatctgacttctcgaggatacacagcgattcagacaaacttacaatgattgattgaatccgggcactcacttctcctaatgtgaggctagggcctgaaactcaagaggttctcgtgtgcttcaacttcagtaagccggcgtgataaatctggtcctctcggcaatgatccagccaaggtaaatcactacggtagagagccagtttgttactctaggcggaacagggcttttcaagagtagactgacgaaagaatccagcggtgagttgagcggtgagatgagcggtgaagtaataaacggtgagatgagcggtgaaggagcggtgaagcaacggtgttgaagcctgcgaagctccagtggcctttaataaaaatcctagcggagcaattagtggcgtgatagaaatgatgcaaattgataaaccgatttcacatagcaggtgaagtagtgctacacgtcaaaaaggcgagacaagcgacagcggtgaataatctcaaagctggcaaaggaacatcaaggaataccgcgctgggcatttttggcaaagatcttaggggttctgtcgttctttgcgagaccaaatcttattcttgaggcagggaagaagatgcagttggtttggtgcagctccaggctgaagtcatacttagaagatgccctcccgaaaattgacgactgtgactcacaacggcgttgcaaagatctggaagaatggaagtttccaatttgtttattgcagtggcgaaagggcacttggcaacatccgagtcctcaaaggcgatatggatctccgccaatggatggcctttggtttcaataagtatatctaaatgatgaataaagagactcagttgagtagaagaagatctagaagtagcacgagatcttcgctggtgcaatgggactagcatgcgtgctgattactatggagatgataaccatgccaacataagacggcatttaaagcttgcggcgactgatacatccattccgacgaagcgggagtttatgtactggccgtgatatagattgcaaccttaagagactacaccagcaatagtgaagatttggccggcgacaagtcaccattttcggccaccggtctttgatatgtccgccttcagaaactattggtcacctcacgacacacttattgacaagctctttaacatagtttgacaactcgacatgggaccccatgggccgctatctcttcaaaggaacagcttggcagccagggtttgcagcccctgaaggtgcgtgccgatgctagtgagcttatcattcactatggctttaagcttacagagaagtgcactcggaaaagggcggctaattacaggcgaatcacatccgcaaggctggccagccccgagctggcgctaaagaagcagcagttctagaggaccacgcactggctataggatcggtgtatctcgtgctagagagacgcgccttgaggatgctacattgccaagatggcccctgttggtcaatgccgagtcccaccggacctttgaccaggcttgatgccaaaaaaccgccagaacacgggacagcgtgggtggccgtcatactgtattacaggcccttaatttgtttataacgtcctagaataacctgcgtcaaacagggttttgttctaactgaatagcagcatcgccgaggcgtcaacagcggatcatccagggaagtgattattaacgcggggatctctgtttgacacctcgatttctccgcagggcttaaattattgagatcctggtataaattccattcagcccggcttggagattcgaaaaattttctggcatcgagcaagcaatctcctcttaaatcccagctcttgagttcgctgcgcatccaacacacgcttctccacgcgccaattctacaattttcgacaagtaatcacaacaaaatggtcgccatccaaaacatccctttagtcctgctcgggctggttggactatcatctgccaatggactcggcccgttccgccaatgcctcactactgcggcttgcggtgttagcaaagtctgtaacttcgagactctgacgtgcatcaccaacccaatggtctccaagcgcgatcttctggtcgatctccacgacaggactgtctttggccacgaccacgcaaagagaaatatccccggcaagcgcagtgattattgggggcgccgaaaccgtgagctatgaaatcaatggtgtgatgtgaggcccagtagaagggcgaccacgcttgcagcattttctatgagcctcacttggcatttcttttgcttttcatattctgagattttcgcctcatccctaaaaggagggttccatatcatcgcaagcattgttttggttaatagccggagttggttcattcttcttgcatttcttacaacccttttcttttcatactatatatatttctacatttatcatatattatggtcaatacatatcttcaacttaacaacacgtaaaacccatgctcctgccgtgctttgaaaatattatttggagttgttttatgggtacttgaatgctagatacctcaataaccgttaccatgaaaagtaccatgttgtcgaatttcgacataacatgtgcaggggagtggctctagcctttcagcttaactaaagcaatggatcgagtcggttgaggctcactcagccctacccaagtaccatcttactaaaatgaaaatttctctacatcacacttaactcacgttgcattctgccccccaccttgacctgcagaaacaccaatctgatcttgaatttgtgggaaggtgttcggtcagcagcagaatcgggttcttcgcatacgcaatgacatacgcaacgagaccgattcggaagaggttcgaggttcaaagataagcccgaactggtgattcaggtgagctggtcgggaaccacccattctggaaaacattacgacatccactcaaggctgaatgcaaggcaagcacggtcagaatgctacaatttcgccggtgctcacgtggagtttccatacgatgacgcaatccaggcatttgtgcctatgacactggtcaatggaacttagaattgtgatgaacgttgtgacgaacagcccccaaatcggtgaaatagccacgtgccaacaccttgggggctgtgatgaatgtaacgagccaatcctgtcagcaaggcggcggcaaacatgtgtatactgtaagttggttggctggagtgcctcgctaccaacagggaaggctgatcctttttccatactgggagtcacttttaggcccccattggactctcggtggcatcgattggcctaagaatctgtgatacgagaaaccagcggccggtgccgaagagggaagcaacattcttgacccagaggcctttgagataaccattctggatgactccattggattacccaccgagtgactggtcttgaaacgacggatcgttttctcttttgtgtgttggtcttgttggttggttggagggcgggccaatgctgagctccgcgccctcgtaattctggtcatcacaattgactttttcgcttcttctttctgtattagatacacctcctaaactataaaacacgtgtctttaagaaataaactcctgcttgaactctttccatttcttcatttcatacgtgcgtaagctctcaaatttggtactttctaattcacacttagcgattaactgaaacatttaccatggctgcttcttcctacactgcgtccaatcttctggcacaagtccagggccagacgatgtatgtgccgcctcttgactctctttactctcgctggatccaaggggtcaacccacttgtcgagaaaataaggcctcttgttgaagagcttctggtgcggtatgtcccccaaaaggaagacctgagtcacgctcgagcctctgcatattgtcttttcgcagctacgtatgtgttcccccccttctatttcaaaaagtggtggaatggatttgagatttaatggattacccagatggtatccagactgcgatttgccaagactccaatttgtcgtcatatatgccatctttcttttcttttgggatgacaacatggatcgtgaagaaggatcttctgatcgagaattgacctacgacatcaatcttggtacccagtaccgctccgaagctaaggcatacgtcaattggcatctagggtttgaagccaagggttgtcctgaaccggattaccggaatcctcaactcgagatgttcggcatggcggcaaaaatcttgagaggaatggcagataaagatactttgaggcgcttccgggatgaagtattcttgtatgttgattcttgccagagggaacaagaagatcgcctttctggaaaatttccatccgcgcagagctattgggagacgagactaggcactagctcagtgtacacgttttgcgccttttccccgtaaggattattcctgtcgttgactcatatgatttgatcattagttgactttactagtttcatcttggggcttagctttcctaaagcgttgttggactcgcaagagatgctggactgctggactgaagtgaacaagaacattatcttgtatgtgctgaactttgagaagatattttggcacttgctgattaaagtttcatgtagcgagaatgatcttctctcatttaagaaggaagtggtaagtcgatctcatggcttcacctatgcggttttggagagcactgaacaaagttctaggctgatggagcaacaactaccttgatcccagtcctcatgaacgagcactgcatctctatgaacgaagctgtagccttatcagttgcagggcttgctgagtgctgcaagagatttgacatggccgctgccgccctgaggaagagggcgatggagtttgacaccaatgttcaaaatggtgttggacgactaattagatgtttcgagactatgcagagcgggtgctacaactggagcaaaaagaccgaccgctatggcgtaggaccgtaccgtaaagaggatggctctctccagttccagctgtgatagacatcggatcgttttattgtgcgccgctagaaatagcccgcttgtggagatgttaaccatggggacacatcccctaggaaagttgatgtggccgatgtgatagagacacgtggactgagggaagttgggcctttccaataattgctgaccaggattggattgggactgatgaatataattgttggatttggcgagaggtatactacggaggactgcagagtatctgcattgagagttctggttcgattcatcttagaattaaatcccactagacgtgtatgcattccccagatctaaaccccccgccaatctggttcagttcatgaatgaggttagcatatctcctaatccctttctcttccggcttttgacctttgccggcccctgctgccctcctgaattcacatcattcgtagcggtcttcttgttaagggttggttgttcaattggtttcccctgtaggatggagggtctgatgaatgtaaatctcttcgtggcaaaaagaccgtgtttgacgtatgacggactaagtgaaataccaccccgtccactgtggccaaggaacagagaggcaaaaggcttagaagggagtacaaaggggccagcaaccgcctgcaatcccggtgatgtgccttgtttctccagatcccggtcattactgagctgcccaatgatcgaatagagccagaacgcccatgcctcgaagatggcaccgtgacaggcgcgtgtggctgtagcggcaccattgcgttcccacgatgggaggctgccgacgatcttggccgagtcggtgaggtagtcgatcagctcaggtgcctggcggtccggtacaaacttgacttcgcatcctgagccgccgcagagggagaggagatcggcatccacactgcgggctaattcccgatgactttttgcctgtctttcatccacgtgtgagaataacgtcaagtagcgtaggagagagtcatcgagagccatatttccgagcatagtagactcccagccttgattgatggcttcttgctcatgtgttggccagtcttctcgcgccccgatcacgtcgtagagcacaagggaggggaatttggaaacccagtggagcgacttttgagttgtagactcgtcaccaaaaatacgcaggacacgcagtaaggggaaaggatctggtcgttccgtccagcctcgtattaggcggtcgctgacatcagggaagtcagcgcctagttcatcagctggacgaatgatctccaagacgcccagattccggatatcggttaaccatagcatctcggaagtggtgaaagactggccgccactgatgaccagatgggtgatgaaatctaccgatggcgacgtgagaggttcgatgtatcgttttaactcgactcgtggctggcagatgtgatggcggtagcggtagaggctcagcgtcctctcttcatcttgagggaggagagctttggagaagattttccacgcgtgaagacagagtccgctttggagtgaataatgtcagcggctcatgtcagatcagagagtgactgtattgggtcgacaaaccgtgcttcgaggaatcgccagatgcggctcacgagacgaggaggaaggacttccagatggcgatcagtcacatcgccgatatgattcgcaaccacctcgatgacggtatcgacgagcgagcgaggcccgcgggtgccgcgaggcttgacggcgggcgtagcgcgtttgcgcgaccagtcaagctcatctcgtgagacgctcacgcgagggatcacgcattcttggtagacgagcccactgtcgggatcgaacttgcgaacgccctggtgagacatgacgatgcgctttatgtgcggttgacgttgcggtgcgtaaagtcacgtcacatttcattgttgatgagagaagcgtgttcggatgaaaattgctgacaaatttcgagtgtgacccgtcaatgagcctgaatatcctcgatgcaacatctaattttttggacacaataatttccatcagataatcggagatatgagaatatcacctctttcaagatttatcggatgtttgagtcaacggatgctggctgaaatagagattcttcctgcccatccacaacggtagactatccgccgtaaaagatatctgacagcaattgggcacagaatgcgtgcggttattcgttcagcatatttcgtgacgtttcactggttgcccgggatacttttctcactcgttgctgtgcctcaaacctatgtacttgatgacccatgctggctgactgtgtttgatttggtggagttgcaccttctttgtcccaaaagaaagaaagaaaggtcgaaatgcgaagtaatctcatctaatggactggttcctgtgacatacataggggcccgcgtaagttgggtaccaagttaagacaattgagaagggcggaaagaaggggcctggtcttaggtagtcatattctgaatgaagtagaaaggcaggcgatagaggaatatattatagacaactaaggggagaagttatatctacgtcaatttgataaacgcttgaatatatagtacagccagatagctgatgtatggtatgttatacatatgggatttcgtatgttgatcatcaaacacatcaagcgaaataatgttgcttacaacagtgattctgaagaacaggcgaaagaacaaaacgtgcaactacctccaaagctatgcacagggtccaacaactggccctctaccttctacccttgcccttgggttttgttgttgacaaagccatagacagttaccgtcctcacacgctttagcgccgcaatcggcgtttgacctgtacgtgaggtccttggcctccacctatatttgagggatccacgttagggacttgatatagaaaagaatacaattgccccgttctctgtagaagggctatattccataagaacgttacgttgatggtaggcaaaagcgtcatagtaatcccttaagaagaagtgcctatttatctggcaaggcaagctaaaatatggggacgattttgaaacctggcatcctgggcactcactcgggagcggagaccaagctccatcgcaaggcagactgatgaccccctgtctttccctctctggacaagcccgagaaaggcctcaaccgaacagtcaacataccgaggctgaacccacagcatgatacaataagaattcgctctttggctttggatctttcgctacgctgtcgactgcatagcattaccaacatgcgttcttcagtgaccgcaagattgcgctccgcctcccttgccgtgggccctttcaaacctactcatatcaccgactcgcctgacctgtcccggaccaaaattggccctgcctcagaacacctacacgcacagcttcttcagctgtactgggaaggagttgagcgggatgtagagctcattatgcgcactctggccgaatggcgctccgaagacatcccgcgaatggaagaggaggaggaggaaggcatggtcatctatggctacgagacatttctggatcatgtctgtgaaagtcagcgtatcaagtcctgggagaatggggtgtcatcacacactgcatacaccgattccttgagaaaccgggcgtgggagatccttgcagacgccgagagcgagcagcgacgaactgccgctaggaaactggtcgagtatgagagtaagaaggacaccctcaaacatcgcgcgcgcatgcttctccaagctgcccaatggctggactttgacaaagtcgtcgagcaccgagaaccacttcacaatggcctcaggttggccccggcccagctgaagttaactatggatccgggcacctcaacgttgaagcaccaaaatgtaacatgtggccagtgtcatacaactatcagaggctctattttcatcaagatatccaactctaagaatgttctgtgtcagaactgttatttcacctcacaaaattacggcaaccaggactattacaagaagctgaaaacgtgtcctctagatgaggacatcactgcagaaatcagccaacaactttgtgattgtagtcaagttgcacaagctcaagcagaaggggcggagggcaagttatttcctatggatggtgacctgggtcagcgacacatccaatgtggagtaacaaatctggacaaatccctggccgaggcaaagtttgactcgacgcggctgaggcaagataagaacaagtcgttgcaggagatatcggtggaaatgctcagcgataccaacaaggcttcaattaaagggttcagaacatctggatacctaagccagtgggagtattacatgccagagtttgggtcagatgagattcacaaggaaggcggaggcacacctccctattttcgcccagcgcaacctcagcatccctttgggcatgtacatatggctgtgaggttcggaacccttgtatttgaaaatggagtagccaagtacgtaccattttcctggcaacgtgtgaattaagctaacgtctgtgccatagcaccaatggtggcgttgttatcactactcgaaaccaaattaacctgcttccaccagtaaaagtctcggtgacgggcgaaagtgagcaaagccttctcctgactggaaacgataagagggtcctctatagtcagagtaggccccgattactgaaacgatacaagctcatcgcgaaacaagtggttgggggtatattttgtgggtatttggataaagaagcggaagaccatattctatcccttctattagaaggcagtgaagttaaaggagaatctcggaaggagtatatgggcttactgacggccgcattgaaggaatacctcttcgattatgttgatcttcatctgagagcaatcgctggcaggctcacggacgcaaagtttaacctggcatggagttttgcgtccaacagctgtaaggacttttgcgaaaatcttcttgatttcgatcatatccggccactgtttgcctcaacgatatctgagaaaccagcttatctcatgagcttcgtgaccaaatcaaggaagcctctggttgtaactccatggtccaaacacgactcaccaaatggcttcgtcgaggaatacctcctccggatacaacatggacgtcacgaagactctgacctgattgatagtctctcagaatactggtcagactttggtgcctttgataagccattataccccaatcaaaacttattcccatgggactgcactgaggcgtacggggaatatcacaccaaatgcgggtcatgtaacatttcgaagcatgtatgggcgtccccttttgatgcatggtctattatatccatgcactttcaccgcgatgtttttctctacgcacaatatcacccgaacatcacgttggcgaaaagccaaatgaaccgaacagaatggtttcgaaacagacttggcctccttgtagcacacgacagtctcctcacagcagccacggccatggcccagagtcctgaaatccggaaagcaactcaatggctaagcgggccagatgttgccccggacgtccaacgaatgaagctgggcagcatccatcgagcacagccgcacagtcatcactttgaccgctccaagatcgggcgtggtggagcaatcggggcactgtttgtggcagattgggtcaaaggctcacagcagtccagaagggacgattatgaacaaagacgagaccagcagatgaagcgtaaggagacaagatgggaacagtcgtatggggctgtatctaaatgccattccagcagtcgctacttctcagaggtgccgtacggaaaggcagacgcttgggactggtcaaggacttcggggaacatgtggtatatgcaggaatatgcaggaggatacgggggaggctcaggcggcgatggaggcgaccataagggaggtgattctggaggtggtggtgactccgggggaggcggaggaggcggtggcggttgtggtggtggatgtggaggaggaggaggtggtggtgattagtcggtatctgatcttagctgttacttctatcttgttcttactgcctgttctttatatgaaaacaaaaccagacaatattaactgcatgataatgttatgagtcacgaaactactcctgtggaggcgcaaccaacagctgaatctaaggttcctctacacaaccttgagtagctgcctggacgtcttgacatgttcgctgaaatttatatcaccaagtttacacgatgcggcatattcagaagccgagatgccgatctcctccaagaagggccagacatgggtatgtggggatcgatggtggctgtgccattgataaactcgtgcgtttatccacagcaaggcagattctagataatgtgcgcatatctgggcgctgccagatgcaggaccgtatcatgagacttgtgatctgatatgacagataatcgggatttaggatctacgtaccttgattttcgcaaactccccaacaccaaaggacatgctcagccaaaagatgccttccaaactcgcatttcacgctccagggccaaatattccgaatgataatatctcatctcttcatagccagtctaccgtgtgcacaaatgcagtatacaacaagtacttgtcgaataccgcaccaacagttacaaagcctgaagaagctctcaaaatccccgcccctcatcttttcgaatttgcgagcctaaaatcattctgttcgtcgacttctccgggctcgtcatggaatcctcctctcatcgcagaatgtgcggtccatctggagttcctcgaaacgctcttcacgatgcgaactcgggttctaaattccaagaaaatcagtgcggcaatggggtattcgagcctcctcaaacctagcgaaatgaccatttcgaaatggcacaacggaaagtggctgaagtacatcgaatttgccgttattcggttctttatatggaaagagtccctaaagcctggctccaagagtgttgactactgtccaccccttgatgtcttgatggtgtggcattctcttcttctcaacccggtcatgcttcatatgtacttcacggaagatcccatcattaatgtcaaatttccctgggaacgcttccacaatcacctgaacaacaaaacttgggaatttagcctcacatcgcttgaaaaacaagaattcatcaagcacacggcgatgagatcacatctctttaccattttcaaggattggccagtccagactgcccctgtcagggagaaaacctacattggactgcacgacttttcatttggtaaatcgccagcggaaaagctctcacacctgctccccaaaggagagaaggccaagtcgatccagctttactcaatggcgtttagacatgccccggttcatatcgcagaggagcttcgcgatgccgtaaaacgccagtttttctttgtggaaaagatgcatgaccacctctggatccgtagtcctggtcttgagggcactctagagagagccacgaaccgatacgacgagtttcttgagctgatgaaccgggagcctggaactatgctcgtcccgacgctggacattgatctgatttggcatacacatcagtgcatggcctcgcagtatgcagaagatatgaaggcgagggtaggccgattcatcaatcatgacgacaagattgccgctgttaagcttagcagcgggtttgatcggacagcagggctgtatatgaagcattttggcaaaaactattcgatctgtggctgctgggagtgtgagttactcacctcgaagatagggcaggttgtcaattctggcgaaaagattgacatgaatcggctcatcaaagatgtagaagatgagatgctgtattatcgtgctgtcgaggttaggagaagggggaagaagcccttacctatccgttgagtagaggaaagcgtgttctcacttgtcttctgagtggtaaatacaacagtaggcaaactaaatatattgagctgttttagaatgactgactttggcctccggggttgcataaatcagcgtgtgtgcacgaattggtatagttgagccggtgtttgcaaacagaatccatgtttaagtatatgcgttgattcgtcctaccgcagctagccgctagccagtattaatattatttggctatagaacgatgaatatcaataatataccgcctcaggcctacccttcacaaagacaggctgtcctgaaagtattgaaaggccctcagaaggtggtgttggaaatgtgagcgtgaagaggacacgctccaattcctccagggcttcaggctttgcttctccaaacatagcagcttgaaatttggatctgacttgagctcgtatcgccaactcgagtttttcttcctcgtctaggtaaggatacaagccaaggtgtccaaagctcgacgactgcggggcctttctctcttcccactcggctagtatctcaatcttttttatccctacaacattgtcagtcaaaggatattgtgacgtgtctagaatttcactataccgcaatgtttaatacttcctgtccggttgttagcgatgattttttatttttgtttttgctcaagctttttggctgttcatacctgccgtaagaaagagagcataatgataaacaaggaaatccggtggattgataagaatctctgaacggcttttccatatactctccccctttccctttctcaagataaaatcttggcaaacggaaataaacatgagattcttcaaggcgttctcgctacacacatgggcggctgttgatgtgagtaatgaaggtgcctaaggggggggggggggatgttgagagacgcacttttcgcaaaggcatcttctgggccaacccttactttatcatctgcaataaggtccacgagatcggaagatccatcggcatctccaaacagatatttgcgccataacttcaaataaagccaatatatagcacagttcgaggtttgaagcacggattgaagtgactttcgcgctgctagtagagcttctaattgtcctgcaataatcgactctgcttcaacctcgatgtggaatagagccattctcctggccaaacctatgtctcccaggggattgagatctgcctctgaatactgttagcgtatcccatgggccttgctcaagggattaaatcttcttactcttcttgtggagtttttcatagatgtcaaaaaactcaagtcttggattgttctggcgacttatttctcccgtagggcctatcagctcacggtaggccacctgcttttcgataaatcgtttagaatcaatgccccacgggatgaccatctccctgtatagaagagtcttctgagatcccatattcttagcaagagcctctagcccttggagatactttagtcgaaactccttgtcggggccacccgagattttgaacgattcgcatgggccactaatgtaagcctcgagtatcttgaggaagatggtttggttcttgaaggccagggtgtcgcttctgtcggcgttttccaggaaaagattgttcagtatctgaacgtgtcgagggctaataggataatatggaagtatgaacttgtcatttgggcgaaacttcccatcatattccggtaattggacaatataatctccaacgatttggctgtaggagttcgttgccttctcaatcgggaggtcatgcaggagagacttccatgggccaaagggctccccataggctgcgtcatatgtttcttgacgccatttcttgacctcaggatccatgtcttcccggcgatctggcagtgctaaagaccgtagcacgaccactagacgcggagaaatggtggcgaattcatgaaagctgccatggtaggatccgtgttcttcgccggtgctctcatcttttatgaaggtgttgggtccttcaaagatattgtaacagttgtcggtcagaacaaactcatcctgtggatcaactggtgtacagagagccatgtaaaagaaactgacatggataaggaaccagcgggcgtcgtcggagaacatctggcgcggaagctctttcctccactctcccttcacatccatcttcaaattcatgatgcattctagattatggtaccaaacatctctcggagtagagaatccgcgctgcctcatatactcgtgcaacctttcgcggtcatcagcgttgtagtcgctggccctatcatggtagaatcggcgatggaaactactaccacgatacttcaatataaaaaagaactttctgacatcgtctcgctcaagtctagtcagcgatatggctctatcgccggcctcgtaggacttgacaatcttccggaagatggagctcgtatgtgattccaacttgctaaacatgctttcaatgcggcgctgctggccagtcgtaggctggttcgggtccaggtacatgccgggggacccgaaaattctcttgactggccggacgtcgattgaaaatggcgtggtctggaggttgacacagttcacgactgggtcgttgggatattttcccttctcgtgcctgcatttgcacttcttcttcccagccagctcggcttcggggcacttgaaagggtacgcaaagttcttgatgaggaattggggaatgaaatgctggtattcatttttgacagacatcgtgagggccaatactgttgactgggtgttgaatcgtttgtgataagtaaaatcagttgaaacgaccaaagaagtagatgaggtagatgaagaagatgaggaagatgaggtagatcagtaagatgaataagatgaattagatgagtaaaatgagtaagataagcaaggtgagtaagatgagaggatgttgaagtgaaataagaagaaatggcggaagcaaacaagaagatatagtgaaggtgcttttgtatggttgagggcatcacccttgggcgtgagggcattacgcccccgctcggttgggttgctctgaagtgtctcagataaaagcagcgcagctgaaattcttctccaccttattggcgcttcagtgatatcttaattgacggcctccaggtgaacaccaatcaaaatccggatggctgcaactgacccctacctttggtggtactccgtcagctctcattgctaccacctgtgcctataagtaccgcccccaaatcaataccctcgtttgattcctctcttcttcattcatctacttccatctacatttccgcttcgctcccttccagtctctttgattatcaaaaacaccccctagtctatctagtcattgaaaacacctatcctcaaagccgtctaatactccaggttcaccaagggcggcaccgcatgccaaaccacgtcatgcggtgccgccctccctcccacgcacgtcgttgtgccgcgtctctaccacatttccattcagttacttcccagttgcagccagtaagttgttcctcttgatgtgtctgatgctattcgaaccacttataagagcaatgtgctgatggcggtatctaggtcagagaaaggaccaggtatgatatttgacgtcgatagccttttgtcaaggcattgatgttgccatgcctgtcttgggcaacagagtctttgcacttcacaaaatccttgaaacgtcaaatatcagatcggcaaagcaaggcattgatgttgccatgcctatatccggcaacccagtctttgcgcttcaccaatgtcttgaaagaggaaatatcagatcggatactttgccgatctacagcatggcttccgaccttcatttggtttctctcatgacctcttgttggtgagatcattaccaagcttgattcttcaattatatctaggttctaaccaaaacagaggtaccagattgctggacccggatagcgtcggtaaaaggtgtccatttacatactttgatcaaagtcgaggtatcactatacaatagctctgcctgcataacatacaacaaactccaatacccacgcagtgggcaatccatttccgctcagctggttcgccatggaccaaatcgagccacaacaccattttttcgcatccttttcggatggcaccattgaccccagagtattaacactcccagccgtctcggaggacctcattttcgaggaagaacaagatacaagtgcatgctcatctagcgggttggaagatattgctttcgacgactgtaatccaggaagcattagcgaatgtaacctcgaataccagtcctcgctcgctgaatctcctaacctacaaaatcatgagatactagacccaagtagcatctttatgcaccaagaagcgggtatgtttctcaatgaatactcaaatttcttcacttgcagcgatgttcttcctttgtcccacgcaggatacccttcctcaatagcctcaatgcctggcccgatttcctatgatcaggcttcgcagacaacacgaataaatagtccgcctgggcgcccattgctgccaaaaccaattggtgcactcagcccagaaaaatccttgcaatgggatgagaaggagcgtacaagggaaccaaagagacgtaaaagaaaggaccccaaagacctcatgtaagtgctcatcccccagcacagtcagtaggaactggagaattgaaactgatactcctacgaaaggaaaaataaacgaaaggagtccaagccggagagatgccctatgcgtatgtgctttgagggctttccatacaagagggagctagaccgccacctggtatctacccaccggacggaggctgcaagaagaggcctggatgtttccaaatgtaaatgtgaagtttgtgggcaggagtttgataatattcgttatgatcgtttagttaagcacatgaaattgaagcaccctaattatcgtttgtagttgaacagaagtgcagctcaacctgtgaacatgccaacagtgtctcggattctcgaatttacagttcccctcgatatcatgagccccgtttccatgatctgggaataaccgggggttgataagtctctcccatagcaccttgtattagccccaacctcaaaaataaacagagccccaaccgaagagccatctgaaacagcaaaaatgcgtaatctgggaatcgaacccagggctccccgacgctgctcggatggcaacggagaattttaccactaaaccaattacgcgtttggttgatggtgatgacctcggttctttaggatctagtcctttcgccgcccctcacaatgacagggtactgaactaaagatgtcatttccatgttcacatcttcctaaaaacgtaaatttcaatcgaatatcacattaaacatactgttgaatcatgatatgtgacatctttgcatggaacttctttgcggatcattatatgaatgagtgcttgcttcattgacatgaatgtgcaaagtaaatctattcctttttgtcccagaattaccaagaatcttgctacattacagagcagagaagccctcctgcagcgactaaaatcccgtaaactgttagtcgcggtatagaaaagggaaaagtcagtctcaccagcagcgataatgccagacatggccccagcagcaatcccatttaccgtaccgtttagagcttggtccctcgtctttcctttgaacgctgcatatatcctacgcatctcgctggcatctctcctggctatcctgaccaacttcataagttcctcattctggctcaagaggtgcctctcaatggtagatggtgaagctgatggtgtagccgatggcataggagacggcgtccgtcgcctgctcgcttgattctgcccatttgagccagagccgtcgcctacttctggggcttttaagagggccaatgccatagctcggctattgtttatgtagtgaagagaatcctccatatcctttaagtcctcctctttgagatttacctgccccatgaggtgatcttcaatctcatcgattttctgttttgctctttggaactccttttctccaaggtccgccatcgactgtctcaacgtttccttgctctcctctaatttttctaactcttgttgccacgcggctttggtttgccgtagttcaacaaggtgtgatttactaccaccatagatgtgttcccgtatcctctcctccaactgctgcaatgcgctctcccggacttggcggtgtctatagacgtcggcggcaacgatggctccggctgatgtctcacctattgtcttcttttcctcaatcaattccttctgtagtcgtaggacctctggagcgtgaaggtccgatcggcggatgagatgagccaagatgcgcttctctgaggatgcctcgccattgtagcccttcctatctgtaccatggtgtctgaacattactgcgcctttggatatcatcgaaccgtagaatttatcgctcccagcgagctcggcctcgcgggcattgagtgtcgccctctcatatttggtggaatgctccggccacattgtcgtggcaatggccaagttatcgtacctgtcaaatccacacatggcctctaccatctcaatagtccgcaggttggtgccagacactcgattgtcggatattggatgtagcaacagcaggccagagattcgcacgccatttgagtaagatgcgcccagataggtggccaagacactcaatgtgtcaatttctgatctgtttgtgtcattgaacccaggagtgtcaatcaagtaaatgcgacggccctcccatctcatgtcaaacacatctaatgagtcggtgcctagccaagattattatacggcggctcgcaattgagaagggggaaaggcctcctacatgagaagagaccatggctgatgttggtatctttccctgtgcagcaggatataaaggtactcttgcccgagcctgttctacctaggaccaagaaaaatctgtcagtggcacggggctttgttgcgccaattaaagctgaaagtcgttgggcctgatcttcgagtcgctcattcacgctctctatctcggggttcattttggttttctagagatacacggagagcagtttgaatccaatcttgcggccagagcttcaagaagactcgaccaaagtgcctaaaagtgtcgtataccgtttgatgatgagaagtgcaatttattaaactcccgacccgacacccttgcgaatcgggaccgtctggtgtgtttgggtgggctcagcgctccccagactcatcagtgcagcgagaaatctgcctcggcgaaccaacttccgctacacggcactgttcagcactcactccagcagtggataacgtggcggtgcttcaggatgcagatgtgcagtgtccaaagcaaatgtgcctttgtccgaaaccccgctctacccatcggcgatgagggcaaaatgattggtgacactctcgtacaaatggcacctacgccaccgttaaggcatacgataaggcatgccgtactgtccctcccataatggtggtcagccgggaggacgcggggcaccatcacagcaagacatgcctatcgcggccggaacatggagatcgctctcatgatgggcggatccagcagtcaagcgaaggggggaagggaggggcccctaggacacaaagatgcgctcaatatggtgtcatgcttgcccgagtgacccgtggaagcgcagctatcagtcgaatccgagcatttattggtgatgtgatgcgtttgtggcttactcctcgcttcctctgactggagtcagctgcgtttgataaccatgtgtgtcgtgcgtggcgcgaatgacgggcctcaggaaaacatcgcagacgtaaatttgcagtttctaccgttgcatccacagcaatcatgcagctatgcggtcatccttggccactgggcgaggcctctgcccaatggatgcggcctgtgaaaccgccaatgcaaccctgctttttacctacatgtgcgtcccatccaagatagtttatttctggcccggtcgagcagcccaacctgccgggagttaggcatcatttccaacactttgacacgcatgaatccgcaaacaaatgtgaggctcgttagctcaaggcgtccagactcgcagtatgttgcacaggcagtgcctcatcctcttgaaacttaacagtcacacaggcccccgccggacggaggaatatgccgtgaatatttccctcccagcggccttataattgcctatgtgaccaccatggccctggtgcatgctgggcctgcccactcacgtaagatcccaactcacggtatcacaaccatgtctgacgacggatgtgaagaattctatgatgctccagccatgccggaaagcgatcagccagagaatgtggcccccgccgcccgggagccgccagagcctgaagactttcgaggaggtcgcgctccgaggtacgttgactcctcctgttctagcatgtagacatactaatcaatctcaacgggtgcagaccaaacgatgccttcattgccgtaatgggcgtcacggggtcggggaaaagttcattcatctcattatgttcagggaaggccgtcagaatcggccatactcttgaagcatgtacgtgaccctatcatcaaccttttctcagagcaccctggacctaatgagaacaggtacggccattgtcgatgtctacgcatacgacatgtcgcccgatcaaaccgtatacctcattgatacccctggcttcgacgacaccaacaagagcgacacagaagtccttagcgaaattgccgtctggctcggaagctcgtacaagagcaagatcctgctcagcggcatcatctatcttcatcgcatcaccgacgtccgtatgcaaggttccgccaagaagaacctcctcatgttcaagcagctgtgtggtcaagacgccctgaagcaggtgattcttgtgaccaccatgtgggataaggtgtctcaggaggaggggaaaaggcgagaggatgaactgatccatacctctgaattctggggttggatggtcagcaaaggaagctccgttcgtcgacacggccataatgagagctcggccaaggagctggtgcaccagctcatcggacacagtaactgcatcaccacagacctacagaagcaattgattgacgaaaatctcacactcgatcaaacctcggcaggtcgagagctcaagagcgagttgctcaaagagcaggagaagtgggcaaagcggctgcacgaggtcgaagagcagatgagggaggccattaagcaacgtgaccaagaggcagaggaggccctcaaggaggtccgggatgagtacacggtcaagattcagcgagtcgagcaagataccgtggcccttcgcttcaacatggaaagtctcatctcgcagcgagatatccgccttggcaaattgcagcagaagatgtacgacgagcagaacgcccacaccgcgcagataaaagagatgaaggaaaaggtggacatcctagcgaaccgtctgagcaccgaatatatgcactccgagttggagcaccaccacaaaaagctcaagccatggccctgccgcaaaggcaagctggcattttccatctcaatggcaggcgtttattatacgtgtataagccctgtgattactcgttggtgagtacgccactcttctgacgctacatcgttgcctacaaccttacctttctcctccaaggttctaacatagatggctagtaacgagggacctggtcaaacaccggcatcaggatcaaaacagctccgctccgtttttcttgggaagaagtgcggcgagagcccaacctggctggcccgttactcggatggtgtcggtacgtgaagcacatcaagactattgttcgttgttccgccaacccagctgacctaaactctcagagatgagtgaaaatctgaaagtggaatatccgcgacttcaagaagctctggcgacccatggagtcgatcatctaaagacttgcacccttgggcccaaccagacctactacgctcgttggaagtcttcgtggagctccaacgtacccgataacctcaaaaacaccctcaagatatatgatcccaagaagcgagatggcgcccgcatcgttactgtgggacttggctacgatggtgcatatgtcatcgcctacaggaacagccgaggtgtcaagccctcacacggcttcacttatggtctcaaggggcactatcaagctcttagagaaatactctctaagaaaaagaacttgaagattgtggtacgtctgttcataatttccacactagcaaatggagtaaactgaccatttcaaggccatcacacttaaccctgagaatgcgacagatttcattctcatttgggaggagaaggccaccaaggggaagtcctacaggatgcaatgctacagtcagtatgaaactgtcatcaaggaggtagaaacctggtggaattggcgctaaggtagtattttaatgtacgcttccggcttgtatacgattggattttattttgtacgcaatgatggttatattctcgccagtgcatttaggctggtatcatctcttaattttttcttttgtctttctttttctaattctcagaatgttctatatacccaggatcaggactagtttcaacaattaattattcgccaaagagatcatccttgtgacggcaagtgaatgtggttgagtccaacttcgactaggagactcatgtccagcttcgtagtaagtaaccgcgggcaggtaggagctcttgttagcaccattcaggttgaagccagggtgatcttctttcccaatgccctaattcacgacgttgaacacacgaaagtaaaattttcgcccgcgtttagaaaggctggccaaaattgatgaacactatcggccggaggtgggcataaggtttggggaaaatgaaaacttgaacacatcttcaattcgttcctacggcgaaagaacgaataacaataatcacaattaaggatttattgctcggcctagtgtcttctcgcgttttttttttttccacgggtcaatgacctaacgatgcgcggtcttccaatggcgtttatctaccctataccaagaaatcaacatattgtgaatcctgctcaataagactttgctcatgcgtaaaaagcctttgatcatgcgcaaaaggagtttggaggtgttttcggagggatatcatcataaagttactgtagtttctttcgctggtgcgtcgcatattgaataagaagacaacaagggtcgttgaccattttcaaaaatatcacacaatcgtctaatttgttactattgaggctagtcttcaatgcaaataagtgcataataacatggataacttgtccgcaagccaagtaccaaaaaggaaaacctcgaagttggcaaatgagaaccaagtgaaacttgtatctgcaaaaaaagaatcgattataggaatagcccgatgcgggggtcgaacccgcaaccttgagatgtgaactcgtaagagtctcacgctctaccgattgagctaaccgggcacggttaggtgatgagttcctgatcgtcccagcgaccaatatgtagtgctcacggcgtcctgattagggcgctgctacagaggacgtgggccatttcagcggcctccagcacgacgctggcgcggtgcatccttctggaggccttcccgaggtgctgtaaatcctgatgctttagagcatctcaccatccgcccatttcgacaacacttgcgacatccacaacaccttcatgatacgaggtaggcagtttcgatggcaggtatcgtgccgcggctagggattcgactcaatctacagctacttgcgtattggtactctcactcagactgaaagcttcccgacagagtgactacctaccttgctaccttatctaacctttcctctgaccgaggcttaatttccccgcaacagcagccaaaactcagagttgataaagtttccttctccatggggatcacgcattccaatgataatccccgaataggtatcccgagacgatcaatggaggtgaggcagagcaccgtttggctgggcagcaagagacagagttgaacccccagaccgcctcaattgaccatgtctcgttcaccgatggtatattcactcatcgatgcaatttttctcagcagaatgacctgcaaagatggagagtgagcaataaagatctacaaaatttaatgctgctgcctgctggatggaaccaccagctaagacgggcagtcccatcaaaccaagacccatttcacattttactatgggtaaactggggaacttggaaagaaaaatcgacagtttttcctgatatctctcatgatcatggtgatctttcaaagtccatggcaagcatggctccatgggcaatgctactgcgtatgatagaaatatggttgattggcaaggggcacatcagccgctcatcatcggatcgcgggcgctcttttctgaccctgccggacgatcgtggctctcctagcaaggatgaaggatgcagtatcaattgtggatgtgtgccaagagcttgattgaactctccgatcgatcatcaatcgttggcagttccgtttcagcgcaagcgtcatcatctggcgtgcgctacccaaagccaattgggcacaatctaccaggtcatgagcccagaaagcgggagcaattggccaaaaacaagcccggtggaaagagggccgctttcaacatggtttgagatgaatatcaatcaagcttctagtgtggcacgttctcgaccgtcgactctggctcgggtgagacctgttttggcctgcgtccagccccctccatcacgatttcgtccttggacctggatgaccgtcgtcatttgcgacagacatcagccagacaagcagcaagaataagcagctgtccctcttgcctagatggagcagaaaatggggctctggccggcaaaggcgtgccgacactctccacttgatgctgcacgatgatattattcccgacttgatagcgcgcagccaaaagtcacaacgtcattcctaaaaaccagacggcccagatgatggtcgagccactttttgaggcgactgtccaacgtcttctggccgtggatgatgccatgggtagagttttcctgtagctcgaccctgcacaccaccagccggagccaagtctaatcctagctgcaaacaacgggccgaatctgcggcttctgcgtgggaggaccagtggcagtgggagctgttcccatttgagacatccatttgacaactaccgggaagggagccagcctgaatccgtgcctttgcctcatccgggtggctgtctcggattgccatcgtagccggcttctgagacaggagcaatctacctgctcgcagaccgccgcctgtgatgattgatcctttggcatgtactcatcaatagcctagcctgccactcggtctgcatgtagccatcccagaacaccgccaatccttgacgtgcggtcgagccgccctaagtgcggaccccctccgccggatccccagcagcagctccacaggaatgaccgtgtcttgttcgtgcccccattgttgatgatgtttccaccgcaggcaaccgtattcttttgcttccgtgacaaccgagtgcgtgcaaaacaacggcccttgcgcatgtagtctgggagcggcactagcctggccggtccttgcatcctgcatgttgtagtagcgcagggttatggaattgagagccgcaaagggcccgtctagaaggtgatgtcagtatcaactatcccgcatccggcccctctggggaggagttgatcctatacgcatccagagagctctccatgtgctcgctctgccccagaactccatcaactataaggactctccgcagtccccgaacctaacgttaattcaaatccccatcctcattgtgtcatctaacagacagggcctcagttctggcctaacgctcttctctaattttggataccattttcacacagtcggggcttccaccaagatgccttctgaccacatgaaggacggctctgccgacctcgtgatccatgccgaccttgagcgtgccagcgagaagctccgaagtgatggttctggctcaggctcaacagagcatatcagccacagcaccaacagcgacaccattgctgcatacgagggcaagggtgccaacattgagaagctgggcacccacgacaagtacgagatcaccgaggatgactgctacgaggagctcggatactgcttcccctggatcaagaagtggtacatcctcaccgtcatcttctgggtccaggtctccatgaacttcaacacctctttgtattccaatgccatcccgggcattgctgaggaattcaacgtcagcgaccaggctgcccgctgtggcgccatgatctttctcgtcttctacgcctttggatgtgagctctgggctccctggtccgaggagttcggtcgctggcctgtcctccagttatctatgctcctcgtcaacatctggcagcttcccgttgccctcgctcccaactttgccaccgtcctcatcggccgagcccttggcggcttgtccacggctggtggctccgtaactctgggtatgattgccgacatgtgggaggcagacactcagcagtatgccgtcgcctatgtcgtcttctcttccgtcggtggctccgtgcttggccccatcgtcggtggattcaccgagaagtacctccactggacctggtccatctgggtccagctcatcctcggcggtgttgtccaaatcatccacttcttcacggtccccgagaccagaactaccatcatgatgaaccgcatcgccaagaagcgcagacaggaggaccccagcgccaacgtctggggccctgatgagcttgtgcccttcgccgaccgcttctccgccaaggagatcatcagcacctggctccgacccttcaagatgttcctcactgaacccattgtgctggttctgtccctgctttcaggattctccgacgccctcatcttcatgttcatccagtctttcggtctggtttacaagaagtgggacttcgacactgtccagatcggactctctttcctctccattggcgttggatacgtcctcgcatggatcctcttcattcccgccatccagcgaaatatcaaggagcgggctgccaaaccccacgacgaacgtgcccagtacgagtcgagactgtggttcctcctctataccgctccctgcttgccaattggcctgatcgggttcgcctggaccatccagggccctcccattcactggatcgcctccatgatcttcgccgccctcatcggcatcgccaactacgccatctacatggccaccatcgactacatgatctgcgcctacggcccgtactcagcctctgccaccggtggcaacggctgggctcgcgatttcctcgcgggtgtattgaccgtccccgccctccccttcatgcagaacattggagccgacagcggccggaacctggagtacgcatgcacgatcctgttcgccatctcgttcgtgctcgtcatcgccgtctatgtcatctactggaagggccccgcgctgcgaaagcgatcgccattcgcccagaagctggccgaggcatcgcgtaccgaaggccacggcatgggccgacgagccagcgcgacgcacgatcccgaaggtcgccgaagtaagtacccccctgtcccctatttggaatctggagaaacaaccgctgacatttgacacctgcattaggctcgcttgatcgaccaggcgctggaagacgattcagccagcagcatcggttctttggcgaaagccgtgtcactccacgcggaaccccacggggcactccctgtgtaagccggcgggctagcttagccaatatccaccaggtgaaggaagtctgaagatgcttaattgtattctgtgttttatgttctgccgaaaattccggctcgggtgtctgtgccaggagaattgtgtttgacatctgtcccgcgatggggttaattttgtattatttctgctgtgatacctcataaatacctactctggactatataagagaacagcgacttgaatgaagcattgaattcaaattagagcactgacccgaggctttaacttgatccatgcatggctaattttagggaaaacgtgctaaccaaggagcagacaggatacagggactcccttcatgcgttggtccacgtgatgcggaatcctgctctccgagaatcccagaatttgcccttcatctttcctcttttcattttttttatcggatgaggatacggatcctctcgggtgaaagagacaaaacgagtttagggccacctctgtcaaaagaaacttcactctccaccggcactctccggccccttcaccgtttgtaatcgtttttctgggtctcggagaccgactgagtggtacgattttgatgagtcggtgaccaatcctcaatctgagatttcaattcaaatcttggggttttattcaaagccgccaggtcagaggatccaattttcagaggagtctctatcttcgtctttacaggtttacaattgcctggtttttcattcaattgacaacaaattatcaagttgtaagtcatcatgatcagcgaaaaggataggttctacgccaccagcggtgatatcacgccggatggaccgagtgtgtggcatatcatagattgggaccagcggcgcaacatatccgtcaaaatgtcccaagagctcgatgacgaggagcccgccatcgaacagctcaagaagcacattgatgaaatcgattccgagattttcctgatccacgtttctcccagtggcaggctgctatccagctccaaagaccccaagtatgaccaggccatgtctgtttactatcctcccatcaaggaagtcacacctgttgagggccgtgatccaattcgacgctcggagctcattgaaattgaccggcttggccctggcgctgacttggtgtcgcatgcacccacaggggctaaggtatgtgcagcttcgttatgggcgagaaagatcaactaatcatgattgaagctggagtttaaatattactgggaccgagcttggatgtttcgaatctgggatgagatgaatctgtggagacgccttccgcggcacccgcatatcgcagtctttgataatatcgttgtcgacgagggaggttcgaaggtcatcggattcacaacggaatcaacacatggggcgtcactcagagaccagaagcggccgacattcaaactcaaatggctcaaacaattaatcaatgtcgtcgatgaccttaatctaaagtacgggattcagcatcagaacatctctactgagaccatcattgtcgacactgagaaggactccatcaaactaacgaatttcaacgtggccgtgcatgttggatccgaggatctctttggtgcccgtgacgatatcctcggcgtgtcctctacagtttacgaattcatcacccgtagaggagattacgaccagcgaggtttcaaaaacatccaggccaggaattggatccagcatcccgaagtcgtcgtggatgctcccggcccccagttccatgcgttgatcaaggagtggcaggatcgccgggcttcgggaccccaaatcttatcttacaaggcagcgcctgaacacatcgagtggccggtcatgaccgagcccgagccaatctctcgctcgtatatcatgcaggatggatccacccgctcaaagtccatcgtcacctattgcgagcggcgaattgacgcccttgcgaatggaagagaggttttgaactgggaaagacccccgcagtccaaattagccaaaggagagagggtccttgcgaccgggaagagggttgagcagcgagagttgagcgccacaaacggtacgcatgaggaagagaagaaagaagcaccggcaatgtgtcctatggggatgatgaaaatgcagttcggtggatattcgatggatgacatggatgaactgctcaaactctgccccttttctggccgcaaggcttgatcttgtgtataaatatcttttcatctcctctctttgaaagcaatgaagaatttcgaatttcgaagcgagtctttcagcgagtttttgaagtatcttagaatgggttcacattccacgaataaatatgtggctagttgccctcaaataacaacaacataacattggatgtaatattttaaaggtgcgcagcgcccctgatacttccactggggccattgacttcgaagacgaactggatgttgtatctcgtgtattgaataaacatggatttgaactaaaacatggagattcatccactcgagagttacattttgatttagccagttgaatatcggtatagaatatcggtatagccctgaccaagatggtcttcttccgttgtaacatatgcttcgggatgtaaacaaaagaacaatggtatgtaccgaaggcggaggagatctgtatcaaagtttatccaatcaagatgaaaatcgctgccgtcagctcaaataaggctctgagaccaactcaacaaatattctcaagccatcgcttgccagatacggcaaggccggcttctagcccacagcacggtgattgactcggatcatctcagccatcgatgacgatgatgacagatcatagaaacgccctttatcgaaataagctaccgtaatacgcactccagacatacttggccgactgtgcggcaaaagtgcaagatattcccatagccggagctaaatatataagccaatattgtcatacagcagagcttagctgagatagcggctgctcacgctcacgtgcaagtggtcaagcattggtgggcgtaacagatcggctgtgggacaggcaatagtgcttccgcatgacattcgccgtctctgaacatcttgttttttttgcctatatcagtgctatgttattctatgggatcttagtggcatatgccatcatggccgcacaacgcggagcggagtccgcggaaagatgtcttctggctatgatacgtagatgctctgttgccttgctgtccaactgccctactgtcccagaaatcagactccttgcgtacagaagaatgggtgttgtcggcccacaaccaatagcacctgtttcggttgtgccgaatcataaatgcccctttatctatccggccccaagtgtgctaatcccccggccacacacatttcaagacagacacgtctctatttggccggctcccctactggcgcgagaccaccaaagcagcgcgcggtgtgattacgcgtttgtaagacaatcaacacagctattactattcggggatcgtggctgcttcctccatggtttgctttgcccaccgtattttcagctgtatgatgtatctcatccacgtggcgctcagctgggctcggcatacatgtgtttgtgaaggctgtacactggtctgaccagccactctcatgcaatcagcatgcaagccagcccaatcaacaccagagatgcgtcaaagcacagctgcgggttgccaaatcgataatatgggtggcagaacaaaaatagtgggatcccgacatattatgaggttggaaaactgcgggggggaagccgcgcgcaccgatcaacccttcttctgccgtccctctcaacagcacatcctccgtgctcttcccctctccatccattccaagtcttcgacgatattcctcaataaccgatggcgcctgtgtccctctcgctaaatgacatccaaggcccactcaacgtggaaatcgacctgcaagccaaccgcatcatcatcggcttccccaacccagagcaggccaaaagctaccacaaaatcgtccaaagccgcgaccggaatggcatagtctcttgccagctggacgggcacaagacatcgctacgtctgccggggagaataatcagcatctctgccagtacgcgatgcggcggtctctgtttcaactttgccgaccttgagctggccaaatggtgggtgggcgagctgctgatctggaagtttgtcgaagggagcaacaggaaggtctatgttgaccggcgcatcggctgccctccagctccgcatacaccggggggacagcatacacccacggccgtgcagaggatgggacatacccgcggcctgagcattggaaccattggcacgaatcgaatctcagcgtgatgtggcgagaacacttcccggcatcggacgggtcaagttccggacgggagttaattaaataatttgttggaatgcaagggtaaacaggagcatatgaattcagggtatcatttagaaatgcgtctaatcccccctcctccaaatggttcaccgttgtctctttggccggtggcatgtcatgttggtacggccacattaattagtttattttgcctgtctatcatcactcatcgatctcctattgcctgttacgcaagcaagtctaatttatctttttggctctgagtatcatcggtccttcaacttgttcgcaaagttgagtgcgaaagttttacagttgtacctttcgtgatgatatacctttccggctatctcagctctggctgtacagtctgttaatagcttggatgggttgaaagagaagcacgatatgtaccacttaccaagagcctcgatttcttcaattgtccagtcgttgtttttcaccaccccaatgtaatctcgcttttccattgttctcttcgttgctttgtcttggattctctcgtaaggaatgcatccgactaggagctgggctccattaccattgttcctctgctgccaggtatgatctttgaaatataggccgtatgcatgaaagcctttcttatagtttcctataacaatgtctttgtgtttgccacccatggcacggataaggtcgttgaggccgtcatatcgtacccctcggcgattgatgaatcttctcggccgccgatcaagtcgcatccatatgtgtagcttatcgttttcagctggtggtactcgcaagctccaccgcacaattctgggctttctatactgagaagacatgttaacggtagctggtgctcagcggatatatactttgctgttagatagagggcgccttgcccggtggttggcaaagtgaaaaagcggtttgtaaacagagagtaggtgaatttgaacatatctaaactgcgacagggcgatttatggactatatatcaggcggtagaacagtacaaaggtctcttgaaggagtttatcttgaaggagtttctttgttccagctgcgacggtgacagaacaaaggcgttggttgattgcttatcattctacacaatgccaatggttttgatttgatatgggattatccttctctgcatcattcgctttcatatattcttggcatggatctaaatttgattcaattattaacactagtcatgattgtatagcgtgaggattgatccgcttaatttttcatgcaggattcacgagtacctcaccgcgttatcattgtcatctcttcttcaaatatgacatagagtaagaaaaggaattagcgttcccgttattctagacgacacagttcccctcccatgctggatctttaacttcaactgaaagctcattaggggaatcagggacatcatcgtcaagggcgttttcttcgtcactaactgatcgaggattttgcgcgtggtcagggtccgctacgatatagctattagttagctgataatcagtaactatgtagctttgaaccccttactagctctgagagcgatcaaagcaactagatcacacacaactggaataaccaggacctggcataacagaagaccactgccaaatacctcaatgatgatatattacattcatattgaaattggagaatgcaagacccgcgcgaacttgaggcttgcaacgtctcgctgctaagccgaggtcttgtttagataatatatgcgcagatgatgagccgtaatggtatgtagatcagcagatggagtctctatcatggttgtcggcgaattccgatgaagattgatttctcatcaccagaaacgtgtctaaaggagctacagagtattgtgatatctactcgagaggtcattctgtcaaaggaaatcgagtccgagcatgttctggatgccccaaaacagctaatgttaaaactagtagtgcttacaacgtggacatcgaattggccgccccaattctccaataatgagctctaaagtatcttccataaattacaaacagactcagtgggaagaggtagaagctaagttatgttcaaaacatcagcgagatggaagcgggcaagcaaggtgagagaagatccgggaactggtcctttcccccccccccccaattgctatcatcactttcaatgaacgccacctgcttcaaactggatttatcactaacacgacgcctatgatctcgcatgctggtagcggatgtcatggctgtttattaactcacgcactcatgtgattgtatctagtaggggttgtaggatttcatgcgtgagatcggtgacatctcccatggtagttgcattgccatcgtaagcgaaatcattcaaacccgatcaacgcgaaccgcgagtgtgtggattgtgttgcattgccccaaggtctaaattgcaagggtatcctggagggtgtcgagcgggacgcagactaatgcgccctgtgatatcatgtctagtcgaatcatgaatcccaagtgccttaaacttttaatagatacggcatcatgaatgaatggaatggaatattgatctcccgcgtggcatcagagctcatgtagcctctctccgcctttgagtgaacgaatctctgaggcgcctgatgttaactgtatgatgcgtgtcactgtggctggatgctctgttctaactgaatttggtccactagttttttcttcgggtgttggaaacaggcgtgcattaaccgcgagtaaagatccccgaaggaagcgaagctgagggaggaatattgggtgacatcgggtccctctaccgaccggatggaagaacagtaagtcccgactgctcatataagtgcaccgagaatcactcagattcttctccaaatcatcacccatcgaacaagacatagccaatcaatatgacagtcatcaccatcgcaccggctggccccaagacggctgcagccacgatccgggctctcttcgagcaagccgctgcctccggcacatctatccaggtcagagcgtactatcgcgacacggccaaggcgcctcaagaattctcgacaaatcccagcttcaaggctgtgaaaggtgaccttgaggatccgtcgtcgcttgacttctcaggctctgatgtggtttggaccaccacaccacctactcctgatgggcgcgacacagtcgcgcaggccgagaaagtgtcgctaaatgttagaaatgctgtagaagcagctggcagcgtcaagaagcttgtgcttctgggtagtatcggtggtcaccttaccgaaggtgtggtatgttactccatcttgaagagatcttgagtagcattcaattgacgatatttcacagggagagatcaagtcaaacaatgcggcggagagggttctatcgcaaacaaaagtcccccaaattaccatcgccaggtctcattacttcatggagaattgggcgatggcgatggcaacactcaaagggcctgagcccttcatcttttcaactttgacgcccttggattatgcgatcaccatggtcgcggtcaaagatatcggcaagatcttggcgcgtgaggttttgactgtcgctggagcttccgccagcgaccaaggcagaacaaacccatacatctttgagatacatggggcagccaagtattcctcgctcgatgtccaacgggcagtctcgaaggcgattgggcaagacgtcgcgatcaaaccggttgagaaagaccagctaagcaccttttttggccaattcatgtcaccttctgccgtgcctgacatagtggaaatgagcctgagcgttttgcccggaggaaaaatggtcgaagagcccgatcccatatctcgcgatattgttcgtggcggtacgagcctagatgagggaatcaaggacatcataggccatgctcgagccgcgacatagctgatcactggcgatgaggatgagatattttttcttcttcttaaaattaggacctcttaattaatgatagtataatctagtaccagaattgattgtagtatttttttcctattgggctcgaatacaccttgaggaaccacccgcgaggccatggggaagctttggaggagtacagctctgccgatttggctcatattattgctatctcatgcctcgagtaggctagacaccctggcatactattgaaacaagatgccacccaaaaaataactcttggccgtcaatctccaccgtaagcgaacagaagatgagagtgaagaatgcggagaagtggttttcctctatgcgagcgaccaattacagtaccccccctgccacgccctattcgtgacttgcgtgtggatgacgacacccaaactttataaccctcatctgtcttcctgatcccattctttgacattagctcttcattatctcgacgcacaagcacaacgctgcagatcatcatgagttctcaatccaatgttccagtctttcactatctcgccctcggacggctcggccgaggtgaagttctcaagtaagatattacctgtgtcatctattaagcctatttgctagaactcgaggcgcgtactaacaatcggttccctcacagtctatttttaaaggatgccggcgtcgagttcaaagagattcggtacccttatgacgagacatggccggcccaaagcaagaagttacaaaaggaaggcattaccaaaacaggtttattgcccgcacttgagtacaagggatcaatctatacccaggtaaggattacgtatataccaagctcaagcaaattcacgtctaactcggctaccagcacatcccaaccctgcgcttccttgcgcgggaattcggcggttacgatggtgaaacaagccaagaaaaatatctcgtggatgctgtggcagatatctacattgactggcgggtatggaacattcagtttgctatgcttgataattgttgctgaccggttcacaggcacagtgggttgctgcgttgaagggagtgacgaacgagtacaagaacgagtttctcccgaactactatgcccagattgctcaatattattctcaaaataagggcccttatcttctgggagataaaatcacatacgttgactttgcagtctaccaatcaattgataatgatatgaggattggatctatccccctcctacctgtaaggcgactgacagagacacataaccgggttcttgctgactctatcctagtctaaacttccagatgagcttgttcagcttattgagacaatcaataaacggccaaatatcgcccagtaccttgagaaaaacaagtttactcctgcataatctggccttttagttcgtgggcatatgtctgaaacgacgtacgctcccttgaactgtaagagttgggccattcaagcatctttctgtttatgggatcgtcaaatttaagatagctggatgagaagtctgatagtgtttatgtatcaggaaccgattttatccattttcgagttctgtcgtatgggcctaatgtgcggctgatgtatgtaacaatgatggaatgtacttgacgttcctaatgtttcctcatcaattaagtggcgagtctcttctgctcataatctactcctgaattcattggaattcgagactcagtaccgttggcgctcccgagttttgccataacctcttcatgctattggcaattaagtgcccgatatcgagccagctgccataggtatcagtgatccaaaaagtgatatgaacacatgaaatcagccgtatgaattccaaaaccatggcttcattgcaagtcatgagaggatgggggtataaaatggcattgcccagccgtttcgcagcgattaactctctggggatgtctgacatcgtcctaccccttaattcttgtgaacaggttggtatcagacaaagagtattcaatttattgagatgtcaggtctggcatcttcttttgttgtttttaactgtataatcgaactcatttccatcggacaaatagtggtgggtgcaagactaatgtgtcagttggtaagcgtaataattttattcattgcgttgagatattgggctctggcatcttccattgccgttgaactttgtactcactttctcttacgcataagcgtaatttattggaaatgatatcgcggcaacgatgctttgtcactgcattacgaaatgagccaaacacattgctctgagttccgtgaatacttgtaattgacattaaaaacaatacacacgaatagaactcattgagattaaactcgtcgtcatggaacccatcgcatcggttatgcgagctccctcttggtcctctagcctcaaaagaacctgtctaccccgttttgaacaaatgttatagagaaagcaaaaatgggtgaaatttaataggattctgacatttttgatggactagaagttgatcctatgtcctttctcaatctaatgacccttaccgtagcataggttcaaccagacttcaccggcttttcaaaaatcgggatttgggtcgcgcacaacgttcagtagcttggggctaagcaaggtttaaggtggcattgtaagccttccgaatttacgccatttggtgcccggatgaccttgagagtttctccaggtcatctgaggcgaaagtatccctatagccacaaactatcccccccgtcgtctgaatacagattgccttatttagagtccacgagcccgcaacatttcgcctacaacactcaacattatgacctaatctcctaagtaaccaaatatatggggacaaaccggtcaaagacaccccgagatactcattacttgctgaattcatcctccccaacatgatgagcatgatgacacctcctccacccagcgacgactctggggaagtgaacccacctccatatacctgccttcaagtatccgatggtgaagctaccgctgctgagcgcgcttgggacttccgggcgcctcgaagctggcgcgaccacaagtaccacaacttagtcttttgttgcacaccttagatctaccacgaaggcgaaaaaggcgacaacctgtggcgacgcatatttagaaggggaaaggctcatcctcattggcgagccgagcttcttgtggttgcgaggaatattcccaacttgatgcgtaatggctttcatatttcacgcgcagacttgctacctcgagctggaagagtttgcttaaatgagacgtcaagggcaagcacttatagcctcgacccgtcttggaagcatgggaggaccttcttcttcaagcatgccggtccctcccccgagtggacagctaggctcgaggtgtttactcagaccactgctcttgccgaaagctttgaactcgactaagtcacgccggacacagtcattcaggcttacgcatatcactgggattggacgttggtgtacaacgccagttcagtgagagccaacacgagctttattacgatcttcgaccggatgcctataggtggatggtggccaaagccaaaagaaatgcagacgacgcagaatgtggtacggttttggaattggacgaacaaatggaagaggaagaagaaggccgggcaatggccagcttgtcacatcatcactagaggcagaaaaaatcacacgtggtagctgcaccgtttttcggcatcctaccatttattgcaatatggttggctaaaatctatatgccaggatgtttgggtccagggttttctctctgatattcctgatataacgctaccgattccccccaggcttacccgatataatcaaagtactcattaacaatcatgttttctttttcgagtggcgttacacgtgatgacattcttacccaaacatgaaacccggagattccgtttccccttttcaagttgtttatcacaattttcagttcaattttggttgaaacaaccctatcgagttttccgttagttgaagtgccaacctctagcaacaatggctcccgcatgtgtgacttgcaagaagacagcgcccgaggtttccatcaagcgctgtgccaagtgctcctcagcaccctactgctctcgggagtgccagaaggccgattggaagaaccaccgcaaagtctgcgggaaagagccagcgggctcttcttcctcttccccctccaatagtggtagccaagcatctccgctgaaagggttggagaaatccgtcacgaaacccttcacgagaatcggcaacggcacctggcttcacaatcgccccgagactgatgtctatcgactgctcatcgatgcatatcgcctacgagtcgaggacgaatacacaatggatgggaacatcgacaatgatagtctctacggcgggtcgggaagcggcctgaagggttttcgtcggtttgtcgaccgcgttgcctcacatgccggtctgctcccctcatggtggaatgccgagaaaagggcctgctgcgagagacttggaatggacccatcgcagtggcagaatctatgccgcgcagttgaaaagagcgacattattgaacactatgggacaccgttttttcacatggagctcaggatgtttgcatggaaggtgcttggtactggcataggcggccaggatgggaccatggtgttggagatgatggcctccagggaagttgatgatgggggcagcggacagaacctaggcagattggcggcagtcgtggatctcaagacaatgaagacatctattctgtagggggccttcgccgaatttctgatacagcgggatgcaggtcagcgaagccaatacctgtacatcatccctacccacccgttaaacttttttatattgactagtatttcaatccttatggcagatacttgccgcactccagggtttcatctgccagttcgagatggcactttgctttgcttcgcacctatggaactgtcgaacgggttctgactctgaccctgaagttggaaggcttcacaaaccagtaagccgtagttttccaatcagcttgtagaccatcagccagctcgaaatcaaagtctcggattatgcgtggcacaagcttgcacatttccaacatcgaaatatgcctcccaatacaagtcctcgagccaacgccaaactaggaacaatcgtcagccatggaacgcaaccagaataccaccaagaaatacgtacgggaatccaacttcggttcattgtagatagtttatcggtatccggtgtgagccatctgtcgggcttgaactcatcagcatcctggccccagacagctttatttcggtgggccgcccagcaattgacgccgacgatggtctgtggagttgatgtcagaaaacgaagaagtcaaagaagatccgatgttacttactccttgagcgaagtatttcccatcaacagttgcacctccttctggcacgattcgttctagaggttgcccaacagcaggatgcagtcgtaacgcttccttgaggacggcctgcaggtatggcatgtcttggctttgcttgtaagtgggagactcagagagcttcccatctttgccaaacgcagttatctcccctcgtagtttgtccatgcaccccgggttcttgagaaggtagtagagcactgctgacagactgattcctgtagtatcggagccggcacctatgttcatggaacaaccagtgaggatatggtctgtggtgaatctctccgggttggctgcattttgcttcataaatttggagacaaactcctcgcttccgtcgtcgctcttttcgtagatagcggcaggcttggccttgtacgcattgatcttttcctgggcaagttttaaaacataccagaacccttgcccgtttccgtgtacagtgagccgatctaggaagctaatggcggcaaataaataagggtgaatgtagccgtagatgccgactgtggaaccatagtagaaggaatcttcgagggacttcatcacaccgccaatgtcgttcccgctatccaaagttccaaggcgctcagcaaaggtgatctgagagatgacatcaagggcgtagcattgcatccaatgtcctatatcgatggtaaccccggctgcagacacttcgtgtaggcgctggtcaaatagtctcgcgcactggtcgacgtatggctcaaaattcaccagatttgacatggagtaagtggcttgaaactccctgcgaagagaggcatgaaatttgatatttcgctccgtaaataaattccatacacccgggaccatgaaagcatcgtaaaatgatgatttggcaaactgagtgctgtgaccatatatggttttgatcgcttcggggctgttgaagctgtatctcttaggtccatatcgaacaacagggcctgttgacacttagtcactgtcctgttccataaatggcctttgaacaggctatacataccgtaagtttcatgaagttcgcaattttttctttccacgtggcccctgtggacttggaataagtaccagatgtttgtaaatcgtgccaaaaagggcccagggacatttcgcagaggtgcaaacaaattgctcagaatgaagtagacagcacacgccacacccaccagaccaagaaggagaataatctgcatgtttgcagtatttgtaggctttttttttactgttcgtacgtcgaaggctggcggcgaatgtggcgagtctcagcgcgaggaacatgcatttatagagatttggtcgtccaacactaaatcattacatctttccaaaaatgagccaatttgtctgttctacagaggtgatgatcgtcccgagctcgctcttcgcttctttatcagaagtccggacagaatgcatcacgatggagacaagcatcagtgacatcgttcactaggcagcacggcgagcctgggtaaatacagatcaactccggattatgtgggctctcgcttttccaatcattgattggctattattcagtttcataagaagagagtgatgtctattaacgctccggggtttccaaatagagctcgggatgaatatgtgtttagtaaaccccacagatcagcggaatgaatgagatttccgcatcccgagatcccgagtctaatacgaaattaggaatgaatcccgcttactaacagcattctagaatgtatgtgaggagaaatgaaacctcgtttctcatgcgaagctccaatgtggacgtcgtgcatggaacttcagctacaggatgcaaatttacaccccgtcaatatctcagacgaggccaggccaggaactaacatttgcataaattatgtaagaaagtatgtggtctatttccaaaaaaaaatgagtatgctatcacggctttttggattaatctagcgcgtatctaaggtagtcatggatataagaaacattcacaattctaataggcccctaactaagcaaaagtcttcgacctggattagtgtgcccatataggtttttgctcgagctcgtgctgcttctactgttcccaagtcacataatgggctaccgtttcatagttgcctcatcgcggttattactagtttggtgacggcagcaacgactctggatttcacgaccggccgtcatcgagccgcaacagaaaccggacccgaaagcgatggatcctaatgatccgcttactagagtctctcactaaagaataagactccacaaaatatgacctacgatatcttagattcaatggaagcttctgcacctccttgacaagcttgggtaagcgtcattggaattctacattgcaagatccggaacaggggccgacccatccttgaaatagtggatcgtatctcgtaattttgagacacttatacgtagcggaagcgctactgagtaaacctggtttgttggggtttgggatcagctaaataggtggtggtgtaccgaaagacaaggcgagatggagagaggtttgtgttcgaattttagaaggaactattagtaaagttctgtattgtatatacttatgcttggacaaacaatgtgaccagagtgtctaattcgcatgctgagcaaagaggaagagatgggagagatagaagcagaaaagaaacgaaggagaataaagttccacgcaggctgcatcctacacaggagaccgcacgtgggttggccaaccattgcttcctgagttaaactgcttttgtctgccttgatgttacttgctcagcgccgtggtaacaacctctacttaagggtatgaccggcctccgcccaatcacacccaagtacgaactcagcagccaccactctgctgagccaataatgtcgtcggtggcttcaactagctcgctgaaatgactgcttagatgcgactcgcgcgccgcccaacgatatgtggcggctgatctagaaccgttggaacggttgcgtagtgtgatagaggcttcctggtgtgatgaggtttccccgcagactggctgtcacccagctatgatgacgaccatttatcccaggagctcggatcctcgggaaacgaaggaatttgtgcagaacacaagcacagacccaacctgcgaccgggcatcgaatctctagaagctgctgaatatcaatagctacgccctgaccaagcgatagatacgcatacgaacctatcccaagccgacgacaagcgcggagaggaacacacaaatgtgagttccggtgacgtatgcgcacatttcagtcacccgaccgagcaaagaaatggccgacgatggctacagcggtggaatcgttgttacgattgccaacgcaatggtaatagctggtttctttgcaatatcactctacaacgtcctcgagatcaatatccaagttttcttcacgttcctgaaatggaagggcctctatttctggagcttgcttatttcctcatgggggattgtccttcattccgttggatttttgcttcagttcttccagctctgcacaaacgactatgtcaatatcacgatcattacccttgggggcatcccgatggtaatagggcaatctgtcgtcctctattcccggcttcacttgattgtttatgacagaaggaagatccgatgggtcctcatcatgattatttcaagcttcttcctatttaccgtcccccctacgattctcaactacggctccaactcttccaacccagctcccttcattgggccgttcaaggtctacgagaaagtcatgctctttgggtttgcagcgcaggaaattaccatctctggaatctacttgtgggaaacccggaagatgctgcgagtcatagaacctgggatgagcgaggcccctcgccgtgtgatgaggcaccttatctatgtcaacatcttggtcatcttgatggatctgagcataatcggcaccgagctaggtggcttgcatgacatccagaccacatacaagagcgccgtgtatagcgtcaagctcaagctcgaattcccggtcctgaaccaactccgcaatctagtcaagagggaagggcgtggttacagctggtcatcatcccatctatcaagtgtaagaagccctggtcaaggatacgacttatcgacaaggcgccattcttcagtcatgcagccgggttttttccaacaacaaataagcccttcaattgctcctcggcaatctcccctcaaaccaaaggctcttccagatgtggaatcatgcacgccgcccgaggactatttctcgagtgggaaacccccaaaatgatttactcttgtgttacttgagatcaaattcctggatcaagatcacgactgcttatatcaggtcctgaatcgtttagccagagtctaggaccaacagggtttgaggaagagattattgatatccgacacccgacctctcatgccaggccaatacattggcttcatgtcatgcgtctaggactccgtcgcgcgcccctatccgatgtgggcttagattgtggcaggctcacttggatcgagtttcggaagtcattgaatccataatggtagttccctgggtgtcgatttgtggtcgttcaacctattttcaactacgctcagcggtctcaacagcagcacagaatgtaaggatatcttctcggttggagcagcacaccgtactgactctacctagttggtgtataatcaaatttcactaccacaagtgatcgctatctttccaccctggataagcgggtataccaatctactcctacatctttcgactcttgttctcggcccggagagcttggttcggcccgagaaaggattgaagtctgagtcttgcgagaggggcaggaaacacccgatcatgctcctgtggagtactggtggccttggcttgaaatcattggtaatgtgatttgagtcgcggaaaaaaagcatgcagcgagatattttgttttttagcctatgtagacactatataccctcctcaatcaaattgtggctctattaacttgtcaaaagagccgtggattgcttccaatggcaatgaagtggtgcatgaacgcttgcgatcaatttgcaagacttcaaccctcactgagcattgattttccccatctaattatgcatccagagttcatactagagctctttataacaaaatgcaacgatagccggttactccagcacgggacagcgagattcagcgaagtgtctccacgcggcttgtctcggtcaccgaaatgattctgattggctcccacccatgtccgaaggctggtagtttggcttggtaatccgtaaaatgggctgtctgggccacggctcgttgattttattaagctggatggattagaatacggacagaatgggacatgataagtataaagatcctagatgaaccgcctagtagaggttctcgttgttatcaaacagtatttgtatcatcccaaccacaacaccgtgaattgaccaccacacaaacatgtctcgggctctacttgtcctaggcgccactggaaaacagggtgggagcctggtacaggcccttctagccaaaagagccgacttcagaatcttggccgttacaagggacaccgagtcagccggagctaagagattggccgccaagtcccccagcatctctcttgttcaaggcaatctcgacgacacggaggcgatttttcaaaatgccaacaaaattgccaagactcccatctggggagtattcagcgttcaggtaggcggtaaatacttgttaacttgcagcgatggcctagtctaacatgcgatgtttgcagctgcccgcgatgaacaaaaacggtgccaagatcgaggaggtacagggaaagtccctggtcgactctgctctgaagcacggcgtggaacacttcgtgtactcgtctgtcgaccgcagtggcgagcgctcaattgacaatcctaccgacgtcccccacttcatcagcaaacacaacattgagcaccatctcatcaacaatgccaaaaacacaccaatgtcctggacgattctgagacctgtggcgtttatggaaaacttccaagtgggctttgtgggaaaaatcttcgcaacggcgtggagagataatgtcaagagtcgccctctccagctcattgctaccgaggacattggtgaatttgcggcacagtcgtttctcagccccaacgagttcaacggtaaatctatcgccttggccggtgacgagttgacctacagtcaacttgtggaagtctttaacaagaagaccggggcggcaccaccgacaacgtttggatttatcgccaagctgttgttatggctctccaaggagatgggtaccatgtttgcattcttcgagcgggaaggatacggagcggatatcaaggagctcaagaagcaacaccctggattgaaggacctgggcacttggctcgaaagcagcccctataccaaggcgaagaagctatgagactgcatctcgggctacggcatacgcacgtggggtctcatcacatcacacaatcagtgttcttaatgtaataatagtcgatagtttgtagaagaaagaagtaatgaaccaagttatagacgctactttccattggcgcccatttcaagcgacgatgccagggatctccaccccgatctcgcttcagatcaactgcgtcaatcaaggctcgaatggcaccatccagccaattatggaactgtgctgctgataagactcagtggcccctcacgcagcccggccgataagcccttcaattacaaatcccgcccgaggttcccctggaagaacataaccatctccaaccacggacaagcaagaaacagacctcagttgctacagttagatgccaattgggatatctgcaagccatgactctcattaagctcccctccggatcggacctgaagggccacaagctcgttctatacgcccctcgaccaactccgcccgaggctgtagcgcatctcaaggccaaattccccggcctcgagattgccgtctatcacaagcagttctttgacaccgacccttatcaggacatttcccgggaagaatggaagaatgtgaccattttggtcacgggctccatgatccctgatccggaagccgttcccaaattgcagtacgtgcagctcttcagcgcgggagcgaaccacgtcgtgaacaagcccctgttccaagagacggatgtcgctctctgcacggccaacggagtgcacgggtaagttcttgatccttctcattacttcatcctcgatcatatacattggggttggtagaagaccgctttcgctaacagccttggctactagtcctcagattgcggaatgggtcatttcaacctttttagcacaccagcatcaaagtgagtcgtccccgaggggagccagaggaaaatctgcatactgactcaatcgccaatagttcctcgctaccttgaacagcagcgcgaggagaaatggagcagggccgacgaggaggagactgaagatgccgtggggcgaacagtgtaagtctcgtcgttcaagatgatgctcaacatcgctcctgtgcaagtttttgttctaacattttcaaacagcggaatccttgggtatggaagtatcggccgccaggtcgctcgcgtcgcaaaggccctcggcatgaacatccacgccttcacaaaccacccgcgcaacactccagaatcgcgccgggatgagtcctacacgcctgagggcctgggcgacccggagggaatcttccccagcaaatggttctccggcgacctccacaccttcctctcatccggcctagacctgctcgtcatttccgtgccgctgacccccaagactcatcatctgctgggacaggctgaatttcaggctctcgcggggcgccgtacatttgtgtccaacattgcgcgtgggccaattgtcaagacggacgacttgattgaggctctagacgcgggcacgatccgcggcgcggcgttggacgtgactgatccggagccgcttcccacaggtcaccctctgtggaaggccaagaatgtcatcatcactccccatgcgagcggcgcgtcgacggcgtattatgagagagtgttgaagattctcgagctgaaccttggtcggttatcaaggggagaagagcttacaaataaggtagatagaaaggagggctactgatagaaaaatgattagggagggttatttcaaatggtatgctcatactcactacttttttctccatctatggatataagtgctttgaagaacggacggacatctccggatgggtcttatcgagagtgaacgaatgaggaaaatattgatgccgtaagaattgcttctacggatgccgatgatggtggtcccggagatcacatctccgggccacggacctgaccacggagtccggtgtgaccaaccctgagtgccaagctcgaataagtggtgtccaaactcgatgttgaaattaaattctgttttgtttgaagtggcagctaaatttagtcattgctgcttatccctaggcatactacataatatcattggccgttacgggaagaggacactcagtcttatttgccaagattcatccacgatgacgagtctggagagcagatgggcggtaaacccctgaacttcgtttcgagcttccacggcatcggcgagcacaacttccgtccaccgatttgttagcggggcaggctctgatcctttccctcaaacagcatcagtctcaagcgatctgaccctgcttgctgacgctcactggcaccttcagtggagacgtcggcatctcatctcaattcagggctgtgcacgctttaccgatggcagtgttaccctggttgggctgagcgatcgtcaattcagccctctgcaggtcccaaagactcaaggagggtaatcatggatctctcctcctgatatcatataaagcatggaaagtccctggcggggattacaatatgcatcatgacgacaagcacaagctcataaccattggcagtctctattcagtcgattgaaactcaagacacaaacctctacatgaacttatttcgtctctttattgaagattctcatacgatggggaaccatatgtcgagggatggcaatgatggaacttgtccccatcatgatcttactgaaggtacggcttgacccaactcaagctgcatacccttttctctagctaaccataagcagattctcgagttaaattcgtaggagatttctctttccacgagtttagtatgattttatcaggagcgtgttgtgcgatcacgctccttgtcatggttttcttcacacaaatgcatgcgatacatctttccagcccaacagaacagatcaagtacgcttcgcccttgcgcatcatacgttttctatactaacaaaggcaactaggatcatgaaaataggtgctctgatcactacgtacgccttggtatctttcttctcagtggccttcccggaagcttcagtgtacatgcatccctggctggatgtgattgagggaacagctctgggatcattcttccttcttctttgcgactacatttctcccagtcaggagcagcgcgagatattcttcgcaacaaaaccgaagtgcggcatcagatggttcaaggtaagatggcttgcttccataattctttgctcatgggatcttcagctaactcaatgaacagcttcgatggcttcagattttccaattccccattattgcactgattctggcaatcatcaccaacgccactgcagctacaggggctttttgcgaatggcaaagaacgcctggatccctcaatttctggacccgcttgattggggcagtttccctggtgatggcgatggtgtctattcttcaggtttatggcgccaccaaggttgatctcgcccgtcaccgcccccttgcaaaactatttgcatttaaggcagttgttggcttgactttcatccagacagtacgtcgccctactgctcatgactcatgaggcacagttctgacaccgattttctagctcatcttctacatcctcactagtacgaacacactgaaggaaaccgatacgcttacttttgccgatgtgaatatcggcatacctaatctcattgtgtctattgagatgatcccgctctccatcttttttctcactgcctatccatggagcgtctatctcgtcgacaattcaagcggcagggcctcaccggattcccagaattctatccattacagcaagccttaccagggcggccctctgggggtctatgcatggatgtatatgctcagccctattgacgagctgaaagccgctatatttgctgtacggcagttctttaccgaccgagtccccgggcgaggaagcgactctcatgagatggagcatgtccccctcgcttaccagggacagcgcatgggtccttgatcatccatgtcttcgtggtttcgtttttctgccgcctttccggagtattgttatcgtaaattggcgaaccaatgtgtaggcttgaaaaccaggggggttggattggaaataacatgggctattagctgttgaggggcgaaggattcaaatgtgacgcaacatgcaaatttgaatgaattctattccctattcgtcaatacgatctctaatttccaaaaaattttaccattcttactactcaaaattttgttatcgctctcgcggactgtggcccgtgaagtgaaccgtaatgatgggactctgcgccatcgccattgcgactttctcactgactattctccctagatttgctatcgctaatgaaagtggcactggtgggtgtatgcaacacacatgggacaatccttcacaacctactcccgttggatccccgcgcccaggtcctccaagcgcaacgccaagcgtccccaggaggaaaacgcttgaggcgggagacgtcaattgtcgatatgagggtaggacatatgatgaggtagatacttcgacttgccaagtcctagcagatcgatatggcatagatattggcaaatttcatcagttgaatcctatacttgagggggactgtagcaggatcaagcccaacactgagtactgcgtgaccggatgcatgtacccatttccccgactaaagcccccagctgctgattcgattaatagttattgagcctctcagagcctatgacgggttttgcggtccctttttcaataatgctacctgtctttacacgggtaacgaatgttgcagtagggagacatggacttgtggcaatagcgggtaagctaaaacaacccagaattcacgacattatgccggctaatggtcatttctctcaagacgtcactgtacgcctagcctctgtttcagagacgccggagcttgtcaagtacgtaccgtcgagtcaactgatagaatatgcggacgagtcgaaggcaggcatacattccgcacatgcggaaaatggggggattgctgcaatcttgaaggaaaatgcgggaatgggccagatttttgcggcagaggtgtatgtcaggaagggcaatgcagtgaccctgattatccaatggattatttgccacaagcgctaccatgggagtttggagaggggttaccgtgaatctcagccttgtatattcatccatttagggcaagtctccaattcgaaacacgatctagttggaactattaacatattaactcctcacgagtctgaaaaccacatcaagatggcaacttgtctgccaagacttggttggtttgtagggtgtagggctggttttatttcggaagttagatcgcggcaaacgtgaaacatatgtaagacacaattattaaaatttaggttttcatttatttatttcacactgctctgtgattcaattttagttaatgtcatagattggaatgactatgtaaggttaagcagtctaagcaagcgcgcttctgagccacaatcaactgttccaaaacttgtatctaggccatatctaatcatcttcgagcaaaggacaatcctgtctaattgtatatacatatcatagaatccgacgattgcgcgtttttcttggagtgagaggtgacgtggtgtagggtagtgcaactcagaaacaacaacatgaactatcacttgagtgtacagcatgcaacatcggacttattattagctatggctcaaaaaggaagaccgccaggcttcagaaatcaaaacatttgggagagagtccatttgatttattgaacctttgtccttggcaatgggtgggacagcttcccctagactatctgagccgagactttccatgaggctgaaatgtacctaatctcacggaccgaagagaagagccaatgcgagcgtggctggtcagcgagttacggaaagggatatcatgattgaccattgctgggacgcggctgagccacaacggcccgaacaaactcttcagctttggtgtggagtgtttctaagccttagaggtagaagaaacgcttgcgagttcacctttctgatagagtctcggcgtgaacagttataagccctttatctttgtgtacggtaaagttatcccagccttttctttcctagcatcgcgagttccgttcatgggccaccttgcaagtaagtggaacaaacgaatccggaagaaaccgtgatattgcctaggagaaattaacatggtctatgaatggtttcatcaagcggatgcaaccgtccagcattgtccgagctcgaacatggtggcggcataaaaagacaaagagcgcaaagtcgtaatatgcggggtgctaaatatggatacggacctgtcgtacatcgtacttcgtcaatgcaactagttcagcccaggaattagatttggtaccgtcaagccatcacggtgggttcctctcgaccgttcaacctcaacgttcgccaccgtacctgttcttccgagatgctttcaagcggatgtctacctaatggaaacctaatgacctcgcctgacagcaacaccgctgctgcgccagtgggtggagaaaatatttctatccacttcccgtagctcaagtcggtgtccgggctgaattcttttcagctggtctgaaatgggaaccaatatttgtcatctattggcctctgaagaaacacgcgttgatcacatactctcatagtccgacattcatgaaagccctcgtattacgaaataaagaactattgtacgcacgacaaactttatgcaagggatatcgtttcttacggtgaactggcgttcatttccctatcaagcctgatcgactttggcgctagatgcgaacaaaaagaacaagccaagacattcgttgctcatttgggatgcagatgcagccagctgagaccgacgacgtacagtagtgcaagtgggtatgatgagaacacgaggagtgagcggaatctgaaacaggcagcattcaggctggaccctccaaacgaggatcaggcgggactgatcatgctaacccgtagcgtcgtttctgctcttttgggcgatgagaaaaaaaatccaaaaaaatctggcacgatggcgtaaagttgacgccaaaatgggcccgctgagtccggtcgctttttgatgggccacgtctgaccgagccacgtagtcgaggcagctttgtgggcgtgtgttattggaggggaatacgtgagacggtcttacaaaatcaacttactgcttggagcacctccgactccttgcctacttggcttgaaactaacaaaggcgggcgagacaaggaccgggggtgggatctgccacccccttgctgaacatcgccaagagttctatttccttgtcacagctgaaggtcgggatcgggtaatattattatgtgaatcactatgttttctgggtgttctttgtccggaggggccgaataaggcgccactgctgaactagcgtcgacactcttctttgatctcggtcgagattttcggctcttagctggtgctagcagtcgatctgtgatgatgttagccttctcgagcttggagcaatgcacgctgttgccggccggtacatgaggcttggcccagaccgacaaagctgagttcccacattgacgggaagggaatacgcagcgtaatcgaaaagctttgatgttacctgaaaccctctattgctgaaacctacttcttgcagccatcgcctccgctccctccacattgacctcgtacctcgactcttcttgacgacctcactcggtgttgtggtgatataggttattgcttcgagaacgtcagtcgcccgaattttcttcacagacaagattactagcaccgacgacggattatatgataatgtctttctccgatatggacgcgatgcggccgtccactacccaagacaggattgtcttgctgggcgcccgcggtgtgggcaagaattcgcttcggcaccaggttgtttcattcctatgtctttgacaaattcaaacctgaacaacggaacactaacatcattcattagtactcggatggcgtgttcggtcatatcaagaaagactttcgtcatgtaccgtgccgcaaaattgtgacggcgggaggccaaacgggtttggtggaggtggaatcaatccgctacttaaacgaaaatgggcgacacgagatcctcgataacctcaaatacaccgacacctttctgattgtatacagcgtcacctccagagcctcgtttgaggccgccgtggaatgttatggctggatccactggctctactggagcaatcgacctggtagtccgggtcaatcccaggtgccagtcacccttgttgggaacaagaatgatctggagggctggcgagaggtgtcaataggtgacggaaggaaaatggcacgagagcttggaattggattctgtgagctaacggcaagggatccctccggtgtcaaaaagttattccatgaggccatccaagcgtcccggcaacgaaaagacggtttgcctgagcgccaaacaacggatgtctcgccaattacaactacctcgtcaataacccctccgacaagccataaaaagtcatcacttcgaagctctcgatcgcgcctaagcaggctcacgacatggcgcagatccatgagctcttcaagacaggcatacgttccagggtgggatcccaagaccgactacggcaagaatgagttgcaggagggcctggttgcggccgctaaggcgaacgatcctcacaaatttagatcatatgcccaagcaggcgctcagttggatggccgcgctatgggcgagaaaggaagtgtggtgcatattgctgccgccgctggtcatcttcaagtcctggaagtcatcattcaacgggaagcaggaatcaatctccccgaccttgacggaatccctccgctgcagctggctgccgttaacgggcactaccaatgcgtggatttgctcttacaaaacggcggcgacatcgatcagacgagtccgcgatatggaacggctctgagcgctgcggcatcacggggccacgttgatattgtccgtctattgctttatatgggagccgaagttgaggttgaagcgtctccattcggtaatataatgcagcggttgtcccgcactttcgatgccagcatcgttcaattcctgcacgagccggatgatgacaccaccacaaactctagcctcggcgaggggccgtctcaagaagcattatcccgagatgtctccggtgtcacgactccaaatgggtcattggatatgcaacttactaaaattgaagaggtcgaagacatggtagagggggattcaaccaatcatgaatatctaccggaaagagatgcgacaattcgatactcccaggaatcagattcgttcaacattgatttcacaaaccacgattgggtcgttagtaaggtatctgattacaccaatgacttgcacaccgcaagcagttcgcccattgagatttgttgaagggtgagactgcccttattatttcacaatgtttggtcgcatggagggtcatggttgggtttacgaggcgtttctgcatctgaagaaaaataggattgctaaaagcagcatggatgggtcatatttggtttgatttcgaagtttgttttaccatgttttgattgtttgctgggttcataagcaacaggtgtcagggattgattgaattcagcacggagccggtttctccgtggcatttatcgttgatggatagaataactatcgtaatgacatatatcatatttttggtctcacataacactctagatttgtaacttcgaatcatttaatcccgaaatattcctttacttggaagagtgctgcggtcatgttgagcccagtcctttccgggtctcaccctcgggttgtatttggccgataccgccactcatcactctactaatgttccctatcaatgaaaagctggcgagagtctctttaaatcgtgtttgggcaatgcacatgtatcatataaagttgattttggacatgtcggaggtcgatcggcttgagagtaagcaatgtcttacttctcggatcacgaaggaacaaaactaaaggaacgccacattcgtcgacaacattccagaagttggctgtataaacatgaacttgacagggtgtccttcagacatatagttattgcatcttcctgctcacatccattcacattgcacctaaaaacatcgtatgcagcacaagcccgcaatatgagagttatcagcagtatcatttcgttcgctatactgatagctggactggctcaaggggcttcgattccggacgcctctgacatcgtaccaagcatcaagacgctagagtgtcgctcaaacgttactgtgtgcgttgaatatgttggtctcccgcacaacctgttactgatggatggctctaacaaataaattcacagtgcaagaaggtcttgtttcttgggcatatcaaatcctcaaattatttctgacttgtttgcagaatatgaaaaagtcttgtctcgatggatcattcatcatggccaacggcggaaattgtacaggacagggaggatcgtgagtaattggccctgttcagacctaataacatgtcgagactaataattttaaaggtgtaaatgtgtttattcattgaaatgtccgcagatttgatatcatcagttttgagtggaagccataaacatgctgaaaaatgtctacacttggatggcaatttctggtggtgaaggcagataactcgttgcacccgctgaggaggcttggtttttgtttaccgacggaaatggacggggcaagggcttttagcctgatgttataagaaaggaacggaacattaggcgacttgatgcaacagctcattctttaaatgctagttacttctcatatcgatggaatccgtcagtcggtagttctaccggcctccaactctagtattctttgattttgttcaccggagagctcgtcagtcccaacctggctaccgaccgcgtgggtaggcttggtttctaattcgggaatcgcttttctaggcttgctgtctagctctggaacggtcggtgctcgcctgttgtcgccttcggagacctggtgaacggtggttgaattctttccccgtccaaaccaccatattaaacctcccgctatggcaataccaagtacaccacttataactggccccgcgatccaggccaggttctaaaaaggtggtgtcgggtttggcggggggtttgtattggtagctgtggctgtacttggtttcatcgggggtgatgcttgggtcgtgatagaggggtggaccgtcgtcgataggtagacttgcatattgaggacggctgtattgcatccataaaggctatagggggcgctgtcgtcgaggtttcggtaaatcaggtatgttgcgcatacactgagtgaaccagagctgcagtcatacctggtgagtaaacaatcgtttcgattactctaaattcaacgagcagagacaaaaaacaccatgtgctcacagaactttgaaccagcagactactcccacttctgcagcctgtgccaatatctgggtttgttgcggtgagacacagtccccgtaaggggttgacaaggtcaaagtgtacccagaatcgcatgacaaagcctcgactttcattgattatcgtcagagggaaattcttcccggaacaaggcatgagttaagtgctcgcaaatccaattttctgatgcatacccccagaagtcagagccaaggctcggccctggattgtctcttggaatatgcacgagggaaggtggtgctgttgtcgtaagatcgatgggattgctgcacactgaaaatgctaaaaaggccaacacataaaatatttgggtctgaaaccacatgattttcattattttgacaatatcgcagcgggagcgtgatggaatagtatccgtaaagtggtgaagggttggggttgtagatcggtgctaaccattattataaattgacgctccaatgttagctagctgatgaatttatctaggaaagggctagggattgaccagcttggtgtttgcaactggttgcacatgttcaccggtaccgagaagccgagtcaccaggtcaagaaagtttaacctcaaactctgccaaatctctgggaagtctagatgctggttggtggcatcgccttgcacccccatagacgtctatttgcgaggcgccgtttaagttcacacaagttctcttgatgactacatcaccgattacaaccatacttgtggttgattttcacatggatcattgtattgcatcctcatggaacaaatcaagggatttctctttcgtaattttcagtgtttggcgactttggcttagattcaggttgatctcattgcagagttatctaattggaaaccgctcaggacgcctcaaggttatcgtaactcagatagccatcttattggcattagcgtgtaggtacaccttatgtccgagagcggttacaagagttgtaagaatcaaacgtcaagattttaaggtagcccactcaatctcctccaacacgaagaaaactagaagaatctttaatagtgagctctataggcctgtatactatttcttcatgtcaggatgtatgcgataggtgaagaggcatcggctttccggtcctcgtagcaagtgcttacatagtttttacctagaaagaagaatatttcgagcgagccgaaaaggtttgctcgaagaaagcctcactgatttcatggcagcctctctatcgcagattttcctcgccactactcaaaaaaacaaattttgcgacttgttcatattctcagatagcactaaccatgggtcttaaccctctctagctgccttgagttcatcaatttcgctttggccaagaagcccaagtgcctcccgacgagtaggtgccgacggatcaaaatatggcttctcagccaaggaggtaaccctagttccgtgtcgaggctcagtcccgctatagtcccagctagcattgtgaattgtgatactgcaaggaataaaaattagcgattccggccatacagagattgaaggggggagatctcataccgattgtcccacaggaccgaggttcgtggtgtccatcgccagcgtacttgaatgtcgacattctgctcatacacatcatataggtaattcaaaatgacatcactctctgccttgtcaagtcctacaattctgtcggtcatggctctattgacccagagtgccttccaacctgtggctgggtggactcgaacaatgggatggattctctcaatgtgctttggccctgcttctgggttctcacggtccaaatatgtgtgagcagagcggtatacggcttgcttgccatcaatgatcttgcgaaattccggagaaagcttctcatacgcggcgtagccactagcccagagagtgtctccgccaacagaggggatggtgtcattgtggaggtgggtgatacctgcaggttgacgctcatgaaccaggtcagtgtgccaccttgatgcacctcctgggttgcggaagttggctgctctctcggtggcctggagatctggccaaataaccgtagcgccgagtacacccggaacctgagggacttgaggctatatagatattttagttagtgagtgtgcaaatgaaaaaaacagagatctaactgtctgctacgtacgtgtacttccacttctccataccaatccccaagctccttctgctgctgtggtgtgaggtcttggtctctgaaaaagacaacgctcctctcagcgatgagtaaagctagctcatcgcgctgctggttggtcaagtctttaagctggagaccttcgatctctgtaccaatatatgctgtgagatcggttattttggtggcggcctccagcagactcttcttcgacttatcggcgcgagcaccagcatcaacatggtcgcgagggatatcgcgaatcttgaaagcatcttggagatagatagggcgcgaaggacggtaaggatatccctgagacaagtctacgcctgccttttcgagcctttttcgtgcaggctcggggatgttgagggtgtccttcttagggactgccacatcctttatgctgtcgtcaataggtgctggggccattgtgtgttttaagaagatcttctggctctagttcatcgatggattcccaaaatatgctcgatacttgagaaggagattgattattatatagtgccgttcggggcttcccccgcacgagacaacatcatgccgttgacccatctctccttgtgatgacagcccatagatgacaaatccaacggctaaaatagatagtatgcgcgcggaaactttcgtgataggcaatattctggcatcataaatagtcttgcgagctcgctccacgttatcgtaccaatcggcgtgaagatgatgacgatccaaatggggtcaaggttgctaccagatgtcgccatacccttcgacgatgaggtgtagcaaatccgcacccggcaattggtcaataggcctgcattaagggtcagctgctgtaaggcgtcatctatctctccgcatcgaattcgtggagagtaatagcatagggctccgtggactggtgccggactccggcttcgcaaactatctactctcattatagaaacatgctagtagatatcgttttgtctacatggtttcaaaagcagaaattttgactgaaagaatacatcactctcgaggtttcaacgccacgaaacatccagaccatattatcggttggcaaagctcgaggtgcaacatataacctatcgacatcgctattcttaccatgatagcctctgggaggattttacctcaaactgtgagataccttgattatcaaaacatcattcttgttgtaaatcaaacataagttcagcttgtcttccaattcttgtcgcgatcattggctgagataagttcttctgtcgaaaattacatttagtttacttctagatctttacccctttcacagcccaagactgtgcgtgctccctgtcccacttatccgtccaagctacttgatgctcattccaacgttcatgcgggtgcttgtcgaaagcgtggttataatagtcgcctacagggacatatttgttgcatagagggcaggagcgatgcccagtttcctgcatgtgtttgttcctggagacttcatcgggcaaggagaaatcacacatctcgcaacgatttggcgcctggaagccgtttgcgacataagcattgcgatcgagggttggttctgtctctgccatcgtgtaggatatgtagccaaagagacgacgaaagggatatcgcacgaattgagtttctggctgaggagtcttggacaacgagagaaatgtgaagagtaattaagttcgtgcgtgacattgaggtaccctggaaaaggattcaatttatgttacctggatccatcgcaatttcgccttataccaacgcttactgtggcttagccatcactgccaccttgcaagtgcagcttctaatatgctaattaatctttcatcattcgcgatacgacatgctactttaggatagccgagcgcatgtatgaacgacgctagatcaagctccgcgaggaggtcgctaatgcactgcatgatatcaaggatttcaacaatcgctctactataggcgggttggtcaccaacatattggtcaacgactattagaataaacatagacgcaaggagacctgtctattttcagaaaattttctgtaaattcataaataattgttctacaggcttatattttatacgctctaaggccttgttagtatcgctgctgaatatttcagattagtatcagtgttcccctattcagtcacggacttatactcaatatccaatcgattatacactctccctctgggttatgaagcttagatatctcttgaagcattctccccgatgacactccagtgcttagtcggtacgatcgcttcaagtcaagtatcagggctatctccccgttccatcaaaggcttcaggcagaggggccagtcatatggcgaggaaactcctaatgttatggttgaatgtaatgctatcgcactcgtgtcctcaacgagcggtatcaaattatgattgtgattagctaagacgaagcgattaacaacaaaatagaaacaaacatataaaaatgagacctcagtcactaaggtagtgaatgtttctagacagtatgagttttcaattatgctccttcctcgaaatttgtacttcaaagaatcctaatgatacatgttccatcctcgttaacagcctccacaaatttatcaagagcagggacttttgattccagcaccgccttttgtactttgagatcgtcggtttcgaaatgcccaacccgaaaaaactgaccgtttacaccttgtgcgcgaatcaataaaatcccctgcatcttatccatctccgtaagtgtatccggtgcgttgagaataggaagcataaaaatctcgctctcctgggcacgaatagctccttgacacgtcatgagtgtaaattgacgatggggttgaccaaaggcatggccatggctggatgggtcccaagatatggtgagaccccatagtctcgagtctacatctgttggtgtcgccaccaacagcttccagattcacaggtaaaagggataaattgagactgttgcttctaactagtaattacagaggggatccgtggccccttatatccctgagaatcccgtgatcgtattctcatgcgagcagcccggtcacgggctcgtaaggtcattccgatatccctctggctagtaataactagggatattcatatccggatgaccaagggcctatcggactgactggtgataccggtcctgaaggtcctatcggactaactggtgcaactggtgatactggtcccgaaggccctattggtctgaccggtccccaagggcctatcggactgactggtgataccggtcctgaaggtcctatcggactaactggtccccaagggcccatcggtgaaactggactgactggtgatactggtcctgaaggccctatcggactaactggtcctcaagggcccatcggtgaaactggtgatactggtcctcaaggccctatcggtctgactggtgctcaaggcccgcaaggtgaaaccggcgaaactggcgccactggcgctcaaggcgctgttgggccacaaggcgctgttggaccacaaggcgctgttgggccacaaggcgctgttgggccacaagggccaataggtccggcttcttatgcgtcgtcctgggactatgccggttgctataatgcccccggcgggaacggcggattcgcctccatcgtggaagacaaacccgagggtatctctattgacgactgcgcgaccttctgcgcaaacgctcagggcggcatcagccctaccttctatttctcgctttcaacattcgaccccattttgggcccctccatatgcacatgtggaaacgctcttgcaaacacagccacagtcgcggccaataacaattgtaatagtccctgcgatttcggggttggaccccgcccttattgcggctcagccgacggtaattacgtgtcagtttttgccagtgtataggatatatcctggttgagttatataggtatattagaaataccctctggaaaagaacgagtgcaagcaagaagcaggccaacggcgaatgtatacttaactagctatatctgtcgtcatagaattcagcctcattctattcttttagcccctgaaattcgcaataatgagtgattgcaagccgagcagcccaatcgtagcttgatacagtagtctggcttctcctccataatgaaatcatccagctctagaacacagaagtatgctcagagtttaaccattcgccgatgaagagcgcgcgtcactagagcgaggtgcagttgaggttcccagccgctatcacaattcttctgttggcgttactctcttggcatactctgtttcctctattgttcctttcgaatctgttgtctcaagtttgatccgatcgatttatgcaacataagcaggttagaataatctttgatttgaataatgcaagctaactaaggtcaatatttctcttccaaaattgtatgaacctttcccgttctggctccctcaataaacttcaattcccctttagcatgggatagccacgtttccgtggtactctacacatgattagtaacagtggtatatttcatccatgtccacgtgtggatagagaatggtgaatttgcgctggtaaaccctgaaacatcacgtcaatagctattgtcagcatgattgatgatgctatggaacaaataggttttgccgagaaaacatctgccgttggtaaatggtgtagttcggagtagtcaggatgactggaaagtccctggaatgcctcctcccgtcggatgtagatagataacattgcgatgtcggatcggtccgggaataccggtcggttaggtgataacagcaaaagataagatcttcaagccgatcgatggggggactcattacgactccagccgatgggtggagtgtttgttgctcggagtgagacaggatcttggtgatcagcttatgcccaaaactattcgccgactgactgggagaggagacatattccaatctggtcgattttcgaattaggtcgtcagatttatgccttcaccaaccactacacgtctcatagctacatccagggtcacgatggcccctaaacctgatatattgtttatagactcgagcgttcagaagatagactttgcccgccgaaaagggtttgccgagaaattcaacattatacaatatgactgcgagtccaccgaggaattcaaagagcgcctgaagcccgggggaccttactcaaacatcgttgctatttcacgaaatggctggctcaaagctggaccgctcgcgaagcaactcccctttggaacagatgttattccatactatccgcccagtctcaaaattatatgctgcagcggccatgggcatgatgcctctgatgtggaggcaataactgctaggggtatctggtactgcaacacgccaaacgcatgcacggaagccgtggcgaataccgggctgttccttgtgcttgattcattccgatatctttcttttgctcagtggtgcgctcggaatgactggctgcagagtcgagacctgggtcaaaaggcggttgatcccactgggaaaactctgggtattgtcgggcttggggatattggtctgggcattgctcagaagtgtgaagccgcatttcaaatgaaaatacgttaccaagggcctcgacagaagccacaggcagaagaatcattgaaggggggagcaatctaccattcaacagtggatgagatgataccccacgtcgactgcatcatcctcgcggccccctatacaagtgatacgcatcacattctgtctaagaggcagtttgaactcgccaaaagtgaagggataagggttgtgaatgtggcacgaggcaagatgattgacgacgatgcactgctcgaggcattggagactgggcgtgttgttggggctggattggatgtgcatacaaatgagccaggtatcaatcccaaactgagggataactggcgggttacggttctaccacatattggagtgtgctcagcaacaagctgggagaattttgagaagatcaatctggacaacattgaggcttactttacgagcggcgagccaataacgccggtgaacaatatcaagaattagaggcttctttcatgcttaggcttaggcaaaatatatattatttttagaaaggcaataatgtcatgtgaaaaatatcccacgtttgatttttgtcacagattaggccaatctggcaaaacgaaatcctttcctagttatccacggttcccattatatagcactgtcataatttttagcttctaagggatgatgtggtgtatttcatgcgatgacgctctgaaagacaatccagcatcgtggccaatttacacgaggctgggccaaaagaatggccagatcattatcaatgagatccacgagtaagtacatgtgcacacagggataggatcacataagtcggcccgtatagtcggcaacgacaaccctgaaccggctttttgatgcgatataatgccgacttcgagtccgagtccccggcatgcgcttcgttctcaacttcagttgtaatgccactcacgtcagtcttctagatcctacacctgacaaatcacttgagaggcagttagactcatcagtgattaccccggtcgacttaccgagctacttgaaaatgcgtaagtttcagagggaaatatttgcctatattcgattactcacagtaatcccccatatagcttcgttccttgttattggcgctggtgtgatcggcttatccaccgcgctcgagctccggacccggtatcctgggtcagatattgtgatcgcggccaaatacctccccggcgattctgcccctgactacacatcggcttggggaggtgcaaactggtttccagcagctcgggtcaatggcacacaggaagactgggaggccattggctatcggaagctcaaggagcttgcatcaacaaggccagagtcaggcgttcagcctatgaacattcgatggcattacgagcgcccaatcgataaagtcggtattaaaactccggaaacagggaagctttggtttgaagagctcgtgggggggcctgaccaagattgatgagaaggaccttcctgagggcacaagctttggatttgaaatggctagttttgtcatcaatgtccagagatatctcccgtggtatgttacaaagaaagtaccaggggcaattgtcactaatgtttctaggttacaaactgaggcggagaggaaagggatctacatccatcggcgtgtctttgggcatatccaagaggtcctggacctataccctcaagtcaatgcggtcttcaattgtacaggcattggagctctaactctaggtggagttgaagataagaagatattttccgcaagagtaattattgaactatctttgaaaatgcccagaagctgcatttgcttacaaagaaatatgtttagggacaaatcatgctggtccaaggacctgagaagccgatcgaaaagatgtacttccgtgctcctcaccgtgatggtgaagcaactcatatatttccacgtggagaacgtggaggagttatactcgggggttgccgacagaaagataattgggatgcggaaatcgacatggagttcgcggaggttatcaagagacgatgctgtgctcttgttcctcaactgggcaagcctgaagaccttagaattatcaagcacggtgttggattccgacgtaagatagaacgttccattcttccatccttatctctaattttactccgaaacaaatctaacattatggcagcgggtcgagaaggcggcgctcgtatcgcacctgagacgatcaacggcaggcttgtcatccacaactacggcgcaggaggaactgggtttcaggcacgctggttcgtttgccacaaatcaagattcttgaggtttctgctaatatagaatttaggggaatggcacgatatgccgtggatttgctatcggaccgcgcaagaatataatttaagcgaagcttgacaagcgtaggagacaggagtttaatttaatactcagggacgagatatcacagtcaggacaattacgatctttgtgctttgtttgaaaaagagagtagacgagagatagataattttgacgcttcgagagaatggccctcgcaaaagcctgctgccttcggactttttgatgaattgatgtaacgatatcgttcaatgcacggtccatattgttcttcaggcgatttcatcgtcgttccattgtcgtacatcccagtacccttcattcacaggtagtggccatgtggcctttgaggagtaggaattacggtgtcagtgatggaaggacttggatggataattctctcagtaagtgtccatatcgtttacaggtgtcgttgaccggcccaccactctggctatctacatcgggcgacggttaactgttgccgtgccgatatgaagtcacatgccgactgcataaaggcgggcgaatctgtgccgatcagtgataccagcacagccgtagagattatttcatatccagagaccctcatgctgtaattgccacctaggtaatacggaatacgtgcaatctagaactagaacaacatactgcataggggcttaccacaacatgggctcaaagccgagagtaatcaccgtggcagctgcacagctagggcctgtcaagagtctctacaccccccgacaagagacactcggtcgcatgatcgccctgcttgatgaagctgttgaagcgggcgtccgactggttgtgtaccccgagcttgcattcaccaccttcttcccctcgcacattattgaagacccagataagctcgctggatatttcgagcccacttcacaagcagaaccttatgcagtcatcaactcgcccaacgtcaagcccctgattgatagagctaatgagcttggcgtcgatgtcagctttggatttggagagcgtttcacctctgaagatggcaaagtgactgatttcaattctgcaatctattactctgcgacccaaaagaggggaattgcgaagtacagaaaggttcatctgccaggtcgcgtcgacatcgatactcgatccaatgtaattcaacagctcgagaagcgctatttcacaccaggcgaccttggcttccaggcattccgggtacctgatctggttgacggcgcgctgaaggcagcagatgctgcttctgaacaagacccagaaggaaagggagatccgatcgtaggcatgctcatctgcaatgatcgccgttgggctgagggatggagatgctatgggcttcaaggaatagaaatcttgctggcaagtccccaaccttgtcgacttgcccttagccctaggaaaaatgattaacgtgattcatcttcgaataggagggctataataccactgcttatgcgccccaatataatggagatgaagcagagcaagaggctgaggctctcttccaccaccgtctatcatgtcagagcggcagctacaccaacgcgtgctatagtatcaacgtcgccaaggctggctgggaggaccatggaaagatgattgccgggtctagcattatcgacccaaatgggcatatcatcgcggagtcaaaatcatatgaagatgagctggtcattgctaccattgatctggccaagtgcaggaagggaaaggagagagtatttgcttttgggagacataggaggattgagcattattcactcctttcggagcaagctggcgtgaaagagccacctctgcttagctacaaagccttggatgcaccgttctggtagagaatacgataccaatatttgaccgaacaagaaattcgaagtggcttcacagtgttgcatcgcatttgtcggcggaaaatcgccgcatccaacccaccatgacgcaccggcgattttgctccgatatgaaatgcgttctttccagccccgaatcggagcgagatgtaaactagacggcccagatacttatataaacacactcatccatcgtaagtctcaattctagccaggtccagtacacacctatcaagttattcatcaagtttgcagtcaagttcaccaggatcaatcgaacatgggaccaacagacgcatcggcggccgacttcctcacagcccaagcccaagagcttcgtctctctgctactctcgagatcaatgagctcgttagaaagcagcttgacatgggcaagccgatagttcacctaggattcggagaagctactttccccatccccaagagtgtgcgagctgcgcatgaagaggccagcggaaacactagctacctgcctgtggctggtctttggaagcttcgagaggtgtgtagcacgccatgaatgatttgagtgtttttttctcttaatccttgaggctaaggaactgtctacgtcttatagtccgttgctcgatttcagactcgccgactgggttttactgttggcccagagcaggttgttatcgcacctggctcgaagccgttacttttcgctcttttcgacatcctcagtggagatgcattgcttcctcgcccgtcctgggtcagttatgagccacaagtgaagcacgctgggaagaaactttactggattgagacagacgaagaagaccgccataccatcacaggtgagttacaccataggcctcaaggacgcatgtaaatattgacttgatacttcgcatacgaaggctcgtctctaaattccgcatatgaccaggctgtttcggagggcagtgacccccgaatcatgctcatcaattcgccctcaaatccaaccggtcaagcattttcaaaggaaactctggaaacaattacatatttctgtaaagagaagaagatcacattgatcagcgatgaaatttactccgatatttgctattctgatacttattcggccacgtcgtgcactgaggacacattcaacgcgggccaaatggtcctcactggtggcctgtccaaggtaagccatggcctttgcactctccaaggttccccgtaggacttttctgacatcctgatatagacttactccgctggtggctggcgtgtcggattcgcaatcttccctcctaacacgtttggcacgactttgcagaaagcgatattggcctatgcttctgaatgttggtccgccgcctcggcccctgctcaagaagctgcggccgtagcctttgacaccactccggagatggacacttatcgctcccagctaagtaacctccacaagcattgcacaatcagactatctggagcactgaagaactgcggacttgccgtggcagcaccaaagggtgccttttacttgtacccgtccttctatccatatagcaagcagttgaagtcactgggtatttatacgagccgtcaactgtcccgttggctcattgaagagtgtggtgtggcagcgttgccagggtcagtgtttggagaggatgacgaaggtgtccgcggtggtcgctatcgtttgagaatggcaaccagctatctttatttcaaggaccaagaagaacgatacactcgcggatacgagctattgtctcacgcattggatgggggagctaatgccacgattaagctgccattacttgaaaaggcgatagtggcaatagagaatgccgtggcaaagctcaagaacgtgtaatgttttctcagccccttttaatcgagaaatttacgagacactttgaaataaaagagatgatattgatgcagaaatcatcaagttatgaagggcccagtatctgttcctgtgggaccgtcgactcaagaccctcctagattttggtcccaaccttgaacgttttcattattccgcaagtcttgtgggaagatatcccaaaaggactgagaaccagaaatccctagaagctgcccaaaagggtccatagtctcccaatggtcggtcattccgaggtcgaagaaggatgaagagaaaggtaatgagccagctggttgtgaatcatcattcatatcgctctctcctaaggaatgtgtcgcctcatatctgcctgtggtacgaaaagcgagccctgtagaaatcgttctctgaatactgtcggcaagaacctcgaattgagcatctatcttgaatagaaggtcgtcgtcccaccgttcgttcattattgccagacatacggagcattttcgagtccacgcaggaaagtcaactagaaaaagagagtggcccgaagttgaagatatttgggaatagcttgtttgggcggtcactgccatagtgagacctgcgaatagaacaccctgcacaagcatccacgagagaggaacattgctggttcgtaaaaaatcaagaacattgtcaatataagcagctgaagaccgaatacagcgctctaatgacgtggttgaagggttcgggcaaagtgggctccttctatgaagcacaaacgaagtaccatagtaaagcctgtcccaatagctattgagtggatgattagacaccacccataaatacttaacaatcttgtagggtttcaaatacctgaacgggtacgcggactctgggctcttcgagcagagggctgtcattgaaactctccaattgtcaagttccgattgcaattttgctacctgatcttgttgtgactgaactgtttggccaggtatgttagaagcactagcataaaccttggatataatccggctttgtatttggcgatgggtaatatgttggatcgcaaatgctgtctgtgttgaatataagggcaggtccgccgtgatgtgttcttcgctaatagaaggaggtcgtccaagattgtaacaaagacttatctcaatcgaataggctgtccaaaatatccgattcttccaatccatctcttcctcaaatacatctaattgtttgggtttattgtgcaaccctatctcaatagccgtctgttacgttagctcggatcgtacttgtgattcgtaggtgaagacacgccactcactcgcatcgctaagccagccatctgccactggctggactcgatcggaccatatgagctatatatacaaacaaggagtagtatttgaatggacgtggggctagagtggaattcttttcctagagtactaaagtactgtaacgcgacggagtagagctgagtcgaggaggggactgatatggaagcctcctgtaagtctcttctaccttgattcaatccgagctgcttgcaagtgctcacatggttggtcgctcctagagccatgaccaaataaaacacggccatctcgctacaactctccgggctctgcattaactctgaaaagggtgcattttgcagcctaccgcatcggtttgcaagactatctagggccgcatggctcaataaaggatataggggctgcacccacatctcgtaggacttttgaagtaaggtgatgacatccggctgaagaggtagctggccatccgcaaaacgtccctgggcctgatttacgcgccctaccctaccagatcggatgacagatgccattgctggctcacatgattggaatagtgccgttgcatagcttgcgaagaaagctccactagacggtcccagatatctctgctcgccggtggcattcagggccagtaggctgatatccggtgcgtcgcttcttgctggagaattaacgtccacgccagctaggtgctgggattctgttggtgaaacaatatggccctcaaggtttctatttaccgagccagatggagcgttaaaggttgatggctccagggcacattccggaggaactccattcgattgccgaggagatctttgtgtggatgttcccgtaggaagactcttccaatccataccgacctcccgagagagctcattctcgagccattctactctcctttcggcttccctaagagctctgatatgaatgagagactggatgaaatatccgcagggtagaatcacagctcaccggatggtgtccgcttttctaagtctggtatatagctcgcattggacagatgcttcgttgcatttcaggcagtttggaaaaccggtgcactaggggagcgtaagcaatcggattcaaatcgccgaaccagggccagctgcgagaatgacatgcttctgaccttgactttcttcctgtggcatcgcacacaggctcggactgcggcatcagccatgactctggagtaactaatagcgatgatacagtgtttggcagtgagcggcagttcgacacaactcagaaagcacgagagaacctgagaacgccatgacaattatgaagatgcagaggcaaagtcagattggcccgacttcggaatattgtggggagtaatctgtctcgtcggcgaaaaatcgccgagccactcaccatcggctccagccatcactcttatctccataccgcattatatccatagttgcacctcttatgatatactaaaattctgtttgaagtcatagatagcagataaatcttccagagcagcatgacgtttgagctgtattgacaaggcagataatagattgctccccaaacgtcccacggtggttcattcaaattacaaagaagaataatcgcccgtgaaaccgtgactcgattccaaatggctaagacagcgtatgaaatgccaaatattttctttaatttggtttctagcagcccagtctgttcacgttttaggaacgtgtcttccttgacaccagtttgccaataagaagctattaagtggatgtagaagctaatcttagagtagaatagttttccgaacgagccaattacgattatcacagctattccacccatgtccttgttaccccagtgctccattgtttgggtgggcttcttggctctctggctcgatatccagctagtcgggctaaataactttctgaatgaagaaaatgaaccagtcaagacgagataatgatttcaaatcagaggagaataagatatgatttatcagcaaattgagcgccctttcctctttcacatattggcatactggggatgtgtccgtcactctcggctttataaatacggtgttgcttaagctttctgcgtgagaatgtgagcaaattctcctccttatatgaaatcttatacgaacttttgagtacagatacaacatgcatacggcaaacggacttgatgtcatttttggggcggccggcattggccctgaggcctttcgtgatgttgcgagagaacagctggatgttcttttggccgaagatatcacggccctggatacttctgagatgtacccagggtgtgaggatgagcttgcgaatctaaaagttaccaacaaattcgagattcatgccaaggtcgctggaggtgccagccctggaaggcagcatgatgcaatcatcgaagctggccaagaacgacttcgaaagctgaacgtggaccaagtaggtgctataaccgccttttttactcatccatgacggaccattactgacactcattacgcacaaggtcgaaatattttatcttcatgcgcctgataattcggtgcctgtgtccgaccaagtcaaagcatacgatgccttgtacaaacagggtgcattcaaacatctcggtctctgcaatttcacacccgaggagttggaagagttttacgacgctgcaaagtcgaacaactgtgttcttccaaccgtctatcaaggctcatacagtgccgtcagtcgtgttgccgagaaggagttgattcccctacttcgcaagttgggtatccgctacgttgcatatgggccgatcagtggcggcctacttgcaaagtctagagaggaacttctcaagggcaccgggcggtttgaccccaacaatttcgttggaactgtctacaatgccctcttcaataagccttcgtacctcaaggcgctggatgcgtggggcgaaattgctgagcaggcgggaatctcgagggccgaactggcatatcgatggatcattttccactccgcacttagtggtgcgtatggcgacggaatcatcttcagcgcgagcagtgttgctcagttgaagaacaccattaagttcttcaaggcagggccacttgaaagcgatatcgtaaagcgggctgatgccgtttggaagatcgttgagcctgaggccccacaggacaactggcatggatacatgaaggggctattctaaagcttcgggtgttcagtagaacttatacaaaactacattccacgaaagttgaattcaacaggtgcacaaaaattgttctcgttggcgtgctgcttcttctcttcacgagaccacattgcatctatggagttggccccttgtccctaaagatcttgaagagaatgattgaaacatagataataccacaaagagagaaggacaagattcgtggtgcgaatatttgatgtaaggcgtgtaagttggatttagggtagaggataactttcatatcggtcaccgactagttgttcgtaagtataatgatatttattttattcaatcaattaatattatacggccaagatgtacacggataagaagataaacttaggcatcttctaaatgaccttcgtaaaatgatcaaagaaggagctcggtttgcaattcctcattccacccacagcagccttaaaacaacacatacactatagccattaggcaattctcagatcgcggagacgcttcatataaaatctttaaaacatagaacgaacataggtcgtaacgcgactggccagtgtctgatccgaatcattagagtcaaacgttctgccagactcactagagcgtcggttctggttcctgatgtcgtcgacaaattttggccaggtgttggtcagaaccaggtactttatgtgactgcatgtgctgtcgaaaacaagatcgtcgaatcctggtgggatttctccagtgtacttggctcgcaggcgcgtagtgctagagttgcttgccgaagagcatccatcgcttgatcccgggagctcaggttgctcaatgtcgaaaggcgtggcagtgttgaccaccggctcaccgcacagaatgcgagtgggtgcctcgaatatatcctcaagacgtctgagctctggccccgacagatttaggggaaactcggcgtctcgcgggctaatgaaatcggtgtagagttgaagagcagcattgtaagcgtccaattctttctctccccggaaatcaccagaaaaggtatttttccacgcagcagcccgggttaagaaggcaatgttctctccagaaaagtcgctaagagccgagaaattctggagcggggtgggattttccctcagaacgtagtcgagagcaccgatcgtgtagaggtggtcactcatctcgttattaaggagattgtccatgatatcgctcttgcccctacttgaagtcgaccccttgcgctcttgatcagatgactggacagagccaaacattgtgatctgggaagacgattcccatctctcgtttgaggccgccacctttcggcgttggatgtttaacttgatgacctggaacacagggacaaaaacagtgaagatctcgaacatcataaccgatagatggatcctttacaatgtcagcgaaaccatccgagcctagcttcttctatttgggttgggagatttttaccattgactgggaggatagtacatgttgaccggtgcaaaggcggggacatattgtgcgattagaaacataggcgtggcgtgaaggctattcaatggtcggtcagtgtcttgagatcctgacacgaggcaggtcaggaacttacttcgagatacagcagccaatggtctgcgccctccaccccatagtatcacggatgtcccaagcgcgccagagcagataaggtgccacctggggaaggaatcagtatgaatgaatccagaagggacacggcaggccacgtaccatccatgtccagatgacctgccaaacgactgaaggccaccattcccaacctctacctaagtcgaccatttgttctacaagcgtagcgcctcgaatctcggtccccgggatgccgaatgtaggatgatatttgcggcaggcaagccacataccgacggttagaagaacctggagctcgatcagcatgataagtcgccaggagattattcatcagagcaacatacctgcgcgatcataccgaggccgataaaggtcatgattctgactgagtagctcatgtttctgaagcggcaaatccatgatgaccccccgccgttgcatcgtacttggacccggtgatcattagtaaactgcttctgcagcttagctacgtgtagaaagcggctattagaggcgtggaataaagcaatgcccagagggaaccagatgcccatgaagaaatactgaatatcgtaggcaagaacaacaggcatggtccctccgatggggtagacaagttgggcgagcacccaatacgaatgtaggaaaaggattgctgtaaaggagagtgggaggccacggatcttaagaatcggattattgcggttgtaccagcagaacgccatgccggcaaagacgaaggtggtccatatgcagcagaagcatatgaagaagatcccgatgttgtcccattttggcgggctgggcgggaggttgtagatagtgaagtttggaactccgtccatgctgaacagattgatgttgggccgtcaatgagtgtgaatggttgtaaggaatgacgaagcgaacagaaagggaacggggattttaaaaaagagtgtctggatgtctcaactttgttgccttgacgggaagaggggctcgttctccatgtggtgagaatttgaagagggatctggcggttagatagaaaccggattgatcaagcggcggcctcactcggtgcttttggattgtttgtcgcctccttttttctttttcttgatcgccactggggttagaccaagacatgcatgagcattttagactcgcgtcccagcttttgagacccttgtcttttcctcatgaggccccatcattttgcttccccggttgtcctcggccaatttgcatttgctttatttgcttgccgcaagaacaactctttactgacaccagatctcgcctaggtacatgggtagactgaagctggaagggctcgataaacctgggttggctggatgggaggttactggtggagctgagaagcctcagctgaagatcaacatagtccgtcaagcctagaccggcaaatgcaaggtagatctcagattcagagacattcggtcatcgcgtggcgcctccatttccttgccgggagtagcactgctctttgaccacaatcttgggtggatttgggcttgcctgccgctcgtcctagttttctggactctgcggctggcaaatgagcggtgctgtcgccctcttgacaaatgtgactgagagagctggtgaccaaatggtgtgtgctgggaccaagacttggctttgaggaaccccacacggaaagggcctgctccgagattcaggagaacagtgcaagattgaacgcgattcgtactaagttggcaattgatgtgcagactttcaccgtagttggcgccttgtcgatcatgtcgtcagtcaaccaaactcatgggccgaccatgatttatccatgctgttaatctctcactatgcatacgcgtagttacctccagctacattgctagcgatagccgtattgcctcccttccggatgtcggtgtgcgtgttgtcctcagtcgtatgcctcgtgatcgacgttatccctgcagcaatgccacgatcgaggcagccaaggtgttgattcgatcccaaattgtgcactacccttgtgggatgtacgctaagagaaaaagaaaagaaaaaaatgcactgagctgaagcaacggaaaagaaaagaccacaatttgcacaaatcaatgcgtgatttcggcaactagcgtaaaagtaaggtttgggatcgacacgctcggaccagactcctgttcttagcattgtttggatgatattgcttgggactgttggtccatcggagcccaaatagctaacctttccttttctcttggcgagaatttcatgagcagccgcacttccatctcttgggttacgtataacatcgatggggcagccctttctggtgaacaagcttaatattcaataaatgtatgagaacttgccttgaggtagtgagagctttcttcggggcatgaatatttggctggcctcccactactatcaacttagccaccgctgctttaccgcttgatctgttatattaggccgatattgcaaaataggatctggtactactcaccactagtctacaagctacatcttcccgacaggctaatagaagctcttcgtgatatagcccacgtgctaagtaagatgtttatttcgtggggacctgccctaaccgtctctcgccttggcaggcagtagcggcaggcttgagttaggtgtcatccatacccatagtcaatccgtagaaagcggtcccggttgtctcttatgatcataacatgatacaggctacgactacggttggtaattcatgcataggcatgcaatttcgtcatttcagccacggattgaaaagtaaagtgcgaacgcacctatatccttcatacttagtctgctctttgaagtgaatagtttagaaattgaaaatgcaatgaattacaactaaaatggatattcgtgagaataaatgtttccaaattctggcatactacactcagttgatcttgtaccgacttgtctgacgccacagctgatatttctctagtgaaatctagttacatgcgtaacatttgaaaagcttattaggcatccgaaccccggaaggtctcgttggacgtgctggccagctgatagctcattcataaacgctaacattgcgactgagacatcgcatcaaactgaagcacaacgtgtggcaagctttaacaagcaacctttttcatactgctggcgccggcaagcgggatcactgtcggtgaatcttctctcggcttggtccaaaaaccaattccgcaagtttaggtcttatatgtcatgccggcctgtcacagtagcctattccatgccctcagacctgaccctgattcaaaataatcctcttcttcgttcgttccattgaaggccatgtcatctctcctactcggtatctcgcagtatattgtcatcagtatagctgcaactttgaacaaggccaactggctagtccgtatttccgaagtcctcatgcagccagcctacgggtggacacctttctgccccattgtgagtgcgtgctgggatatatccagggccgttgttttctggactagctcattcaatcaggtggtccatattgtcgtacggccatcggtttactaaggctttgataagccgtcctacttccggagacccatgcagctggccaggaacatcacgaattcctgcatagctgagccttggtcaacgagccagcttgccattacatggatgatagttactcttaaaagacgtttcggagtccgtctccgttataatgaaaattccatccactgtatggttacactcggtttcgctttcaaccatccatgctacctgaaacgcgggctgcatgtctcctccatatgacgacatatcgcaacatcttatggaacctgcttctttcaggcacatcgaccgatccgtagtttaacagagtgcctggcattgcgctacatagtatcgaaaaacaaccataaacctcatccagcgaaggagcacgccataacctacctcgtttgccaggtagaacagtgcaacgctgccaccttgaacgggcatgaatgaacgagctcgccgtttttccgccaacggcggagttttagccaagaagtagcatgtgttgcattgactcaaaacccattgttttttgatcgtccgtcacaaaatgggctcgtagtatcataccacgttgtcttaaccggatctggtgagcctctcttggcaaagcaagatacgtatataaaatatagcgtcaaatcctcaatttatcagtatcacacctcctcacaatactttcaggtaccatccacctgcgatccattcagctaaaactgttcattatgcggttttccgctatcctcagcctcctttctgtggcagttgccctgccttctgcagtgaactacgacgcccatgacaatggccttagcatcgctgagcgggaagtaggaaaggttttcaaccgcgcccccgagcaatccgcccaggacattgccattctcgtcgagagagccctgttggatcagactgccgactggccttccagcagtgtttcgctcggcaacatcagcttccaaatccaggtcgacaacctcggcagtaaccgcttcaagatcacttggtggaactcggatgctgccaactcacagcgcaagatcaagctcacctttaacgcgggcgacggcgcccgcctctacgacgttgtaacctcgccccagacaaggggcaacaccgaagtcaccaagcgcggcacccagttccgtgctatatttgaccaagagtaagaagagtaaaatggcctcagtgggcgaaagcttttgggagaaatgaggcagcaaagtgggctcgctgggtggaggggggttcactagactcaaccttcaattcgattttcttgttgaacttaggatgggggaggttttccaggccttttgcttttccttcccggtttgaatgagctgaagccccaaaagcatgtaaatccaaacccaacagtagcctaaatagtgaagatacattctttgcacaaacctgaaactgcccaccgcagaatattttcttgattcggggaagcctgtgaaacgtccgacaaaatcgcactcacctcaattcggctcgatggctctgagctgaggctattgacacatgtaagtgagtgaccccagtggggaaaaaaaacaataatagcagagacttaaccacaagcaagataattgtgaagtaattctccttgtcctgatacctttatgtatctattatctgccaaatataatgaaggttttccaccccgagtcagcttcacgagttataaagttctacttgttagcttcgacagacacccacaaatccgaagccacatagaagatagtataagctctctcctactagggggatcatattaaaaagaagaagaagaaaaaccatttttctgcaagcgtcatgatatccaccgaaagaagagggtagtttgacatccacccaaaatgtcatacttcggacaatccatgtaaccacgtgagctgccgccacgtcaaaaaatacattgtccggtccgtatatatgatgctgctggtcataattatttgctaagcttgatcagggcccgtcggaataggtgtatgattatggtccctcgaagtgtccaaattgccaaccaactacggcatccacgccttgaccgagggattcctatctttctccgaacataatgatgctaccgctactgcatctcactcctaaatgagacatgttgatatgcggcggcgggaaacagtagcaattatgagccggaacttcgtccggtatcagcagcaactccggctgccagtcgcgtcaaggcaatcctcacatgtctgccgcctgatgcaagccaaacgggccttgtattttttcaacccatcgcgagcagtctttagatttcgaatcagaaagccaatgacacaagttaagagtgtaacaccgagctcaggacttaccgaaaattgagtgattattctagatgatgatgtcggagacttggcgtcactaaaatctatgatcgattatagaaggaccacctgtccgtagaggatccataatgtgcttctccaaaagacgtggatggtcgtctacgtagctcccgctcattacgtttgcatatttggcatgacttctcttgtagtacggacatgggtttcactttctgatgatagaatgtatcatccttctaagcgaagagctagttagtaggaatgattctgcgagctgaatctctatgtgtgctacgtgtcttcgttgccctattcaatacagccctgttcgcttcatcacctgtgagggggttaaaaaccataaccctaccccaaggccgtcgtataaaactcagcagccctcgagaaaaaagccgagaatgaatcaatcgatggagacaatggatttagggcaaatcctttttcactgaaccctggggatcactacttttttgaggccatcgctttgaggctcattccagaacatagatacgcgtatccgcctcatcaggatcagaatgctgggcgggacggagtttgcggcaaacccgatccttcatgcatattgcgacgcatttcccagggattcagccaatggattggggcagcggggtgttgagaataacaccatccggtttggagctagctgaatgtctgctggtcctgtgtcacaggctcggtgaattggttggcggacatcggctttggcggcggatttatcattccctgacctcataaggacgccattcccgtttcgctgtctcagaactctctcaatcacaacaattgatccgtcgtccactcctcgcatcatgtcacagctagtgggactgttgcgccggaactatcgcgcgacggtgagcccgcccgttgcgacgaagagcgaccaagcactgcactttggcatcctcggcgctgccaacgtcgcgtacgcaagcaccaaacctagatgaattgtgcccggcgttcaccagctaacacccctctaggccgtatgcattcatctccccggcaaagtcgcaccccgaggtcgtcatccaagctgttgcagcgcgcgatcgcgccaaggccacagcctacgcagccaagcacggcatccacgaggtcaaggacagctaccaggccatcctcgacgaccccaagatcgactgcgtctacatccccctccccaacgggctgcactatgagtgggcgatcaaggccctgcaggcaggcaagcatgtgctcgtggagaagccgtcagtctccaattccaaggaggccgagctgctgttcaactcgccgctcttgaaggagcccaacagcccggtcatcctcgaggcattccactaccgattccagccccactggcagctcttcctgacactcctcgatcaaccgaatatcgagtcggcatacacgtgcgggttcgtgccctccatcatcttcgccaaagacgacatccggttccaattcagcctggcgggcggcgcggtcatggatttcggtgcgtacggcatcagtgcgttgcgccagacgttcggcgtcgagccagaggagtgcatcgaggccgacttcaagatcatgccgggcacagaaggcaagatcgagcagagctggaaggcgaagtggcgcatggcaaatgggggaacggccatctccgaggggagtctacaggctaagctgacacagttcggggcgcctcgcgtggacgtcacacaccggcagaccaaggtggaggaggagggcttgccgtcgggccaggagaagtgggtgactcggaaagtggtgctcttcaacttcatggtcgggattatctggcatcggatcgacatcgaggacagcttcgagcttcgcgagtcggaaaccggcaaggtggtcaagaagtggacggagaggacgtcgcgcaaggcgtatactttcaaagaagctggtctggacggcccaggagaggactggtggatcagctacaggcatcagttggagcagtttgtcaaccgcgtcaaggggagagagacgcggacgtggataacgggagaggacagcattgcgcagatgaggatgattgacatggcctacgagaaaggcggcttacccatccggccatcgaggcaggctgttgatgggaaatgatgggagccaacgagcgatagtatcaataattctgctagattgcagtggcgggcaaacaatgtctcggatgcgatgtgatgattgcaatgtggaagtgcggtgtagggtaacaagtgggtgagaggagaaatgagacaccaaatggaagagtggttaaaaagagactctcttctgatttgaatcgagaaataccgtagtataaaatggaatatagtaataatatgtaccgtattatctctggagtttgtattgttagtactcaataatctgataccggccacagactcgagaataagcagcttaatattcgagtctctttctcgcgtcacccacttgttaccctacgcctctaatcagtaatgaggaaggcgccgaggatcgtcgcgcctccctaaaagacgctaaattatggcgctttagctgctgcgccacgcgcatcaaataagatgacgttgtttgaatccttcaacttcatgatatgatcagctttcaaccttccagccttattgcctttgtataccattccattgaaacattgctcatcagctccgctcaagatgccctcaacgtatgcaaaatcgaaccacgacctgggcgtccaggtcgaacggtctaactacttccccggagacaccgtcattgggaccatccatcggaggaatgccatggtctgccctgaagccaccgtcgatgtcgtgctccgtggccggacaaaatccaaaatggtcgtgagaaggaacaacaatagccacacctaccgcgggcgcttcacccttctcaattcaggccagaaggtgttccaagggccggtgcatatccccgaaggcgctggtgagccacagcaatggggtttcgccatcaacattcccacaaacatcgatgcgcgtctgtttccgcagcagtatgacgcagccgagtcatatatccccattgaccctgcatctgtcggccagatgcccctccctgcttctttcagctctggatatggccgaagggaggctttcatcgagtactacatcgaggctaccatccgataccagcgaaaaggctcgtggcacacggagaccgccgtggtgccaattccagtcgcgcccctcaaccccaatcccccagttgccgatttcaacttactcggccgtaggattcagcaatctgtctcctctcagcgtctggtcccgggcatggagaatgtggaactatctaagaaggagaagatgaagaagttttttggaagctcctcggtaccgagattcgcgttcagtctagagctcgctgcaccaaggttactccagatcggcaattctcccatacccttctccatgcgtatcgtgcctttctggtcggccacaaccgaacttatccgggatgtgccccaaaaggcgaagctcgtaaccttcagagccacgttggagacacactgccgaatcagatgcgaaggtgtattccgcccccacgaagcatactgggacgacgaattggatctacagagcgaagggtttggagaccgtccgctgtcagttgagatcccctgcgcgataggcgatactccaccggtagatgtcggcggtgtgattcgacttcgtcttccggcgaccggagtatcaccaggattcaccacattcaacgtccgagtcagccatacattgtcttggaaggccaaacttgagatagccggagagagcttcaccgcccgcgcagctcaacaggtggtcgtgatcccagccagcagcgccggagccaacgagcaggtgggactggatggcgagatgacgcagtcatggattgtgccgccggatgagatggcacctcccccaagcttcgccgaggcacagagggaagatgccaagcagggagcatctgataaaggggcttctgaaatcgcgggttcgagtaaggccgatattgccgctattgagaagcgaggaaatctgaatgacgcagcagcctcggacggaaagttgtagcagggattcttttgttgtgaactgcaagcgagactgtctgactatttttatattgaagtgtacaatattgaattaaagcgatcattgagggggaaatagcctgataccctggcccttactccgaggattgttgggacaaggtgatggaaacaaaagggcggggattaagacactattgtcttcaattcataagaaagcacggctctttacagtctttgtaggtatatttatctatcactctttcattcgtctcgatccaagactaggatacctcagctttggcacccaggcttaagccgagattgtctgcctaataatccgtgctggccgcgatcttttcaaacttctcaagggtctcactgagcatagccaccttcttcttcagcatgccgtaacagtccgatcccattggcattctcagttggtcctgcaagcccgcagccatccccgtccccgtcaccaactcatagatcctctcgaccccaagctgtggattgccaggctggctcccgtgtatggcacccatggcgctgccaatgtcaacatacccttccttcttctgccccatgttcctcccctccgccgccggctttaggaagttagtcctgaagatgcccggctccaccagatggactctgatgccaaacggctgcagctccgaggccatgctctccgtgagcccctcgacggcaaacttggacgcacagtagactgcaccgcccggaccgccgaggagaccagccccgctggagagttggacaatcaccccggacccttgcttcctcatgtgggggatcgcggctctcgtgaagttatacaggccgaagaagttgacgtcgaactggtaccgggcctcctgggaagagatctcctcgacggcgcccacgtggccgaacccggcgttgtttacgaggacgtcgatgcggccgtgcttctcgacgatgtcatcgatgatgccggaaatttcgacctcggacgctgtcatttcgatctgcttgaggactgcggaggaggtttggagggcctttgggaatttggcgacgctccttgccgtagcgatgacagtgtcacccttggctagggcgtgctgtgcaagtagtaggccgaaacccgaattgccgccagtgatgaaccaaactaaaggagccatggtggtgtttatggtggtgtttatggtggtgttcttcacttggtgctagattgatgtcgtttgtggtgagtacagagcctgaaataggaattattattatgggtgattctataatctaggaattacaagctgagccattgagacagagtcctttatatacctcattttgactctgggaagtgattatcaattattgtccttttcccgacgattcttctctttcccgctcctggtcgggtttggttagcatcttgagtgtcattgctgacggatacgtccacggcaaatcatacttaactatttctacctcatgtcagctaggtgggtatcagtggagagcacgcgggcgagtcaaagtgaacagtagctaattagataactatctatcgcctgtgttcaatgtttttatttcttgggaacaatttggaaagcttcgcaacgcaagatcaaaggtccaactatcagacataaccctaatacattaatgattcgaggtttgatcgactagattgactcggaatttgaggaacgtagccattgtctcccaaaatatccattctcacttcaatgccactcatccataggcaaattatgtccacgccatcttggaattgaatgtccggattcctgtctagacgttgagcatgaacttcttctcgggcgggatgcaagcaggcttgtggttggcccactgcgctttctggcatttctaaatggtgcaagtggttagtcttaatccgcgctttgaatagaggaagagaggacagacctgagagcaataccaggcgccacggcagcgggagcacctcttgggagagaacccaagatcaacctcgctccggccacacgtgaagcagctgggttcctggaagtcgcgtggggcaccggcggcatagttgtcgaaggcattgaggaactgaacccgacctggctcacggaatccctggtcaaacaggggcagggcatagcgatggttgcagtggatcttgggaaccagcccacggaggtactggatgtggttgggcttgatcttggcacctgcacgcatcatgagggccccggcgatgatgattcggtatgggccgtcaaaggtgttctgcttggcttgggcgaggactttttcgaagaagcagtctctgagacccgaatcgagctgggcgcggacttcggcgacattttgttcgaggatgggcttgtactcgtcggtttggtagaaccttcgggcttcctgaggggctagcatgtcggtttggaagaccatcctgcttagtttgaggggcttgcccttgagaatctcgcctagatcgccggcaatgtcaatgtcatggtcaccttcgaaaagacctgggagggaatatgattagcaatgatggcggctgagaaacgacaggcagattgtcggcgagcttacgatacccccagcgacccatgatggaggtctttaggagaggacgggtggaggagagatctgcggtggtgtctctgcagctgggcagatgatggcagattgttcaaggacaggaaaagatggtctgcgaggaatgaagatctttgggtagaagaatgcaagagaaaagagaggcaagcaaaatggaaagaaagagggacggaaggaggtgagtttggccggcagcctcaggcagacatttgactctggcggtcgcacaggtatctttaggtacctacaggcacaacactcgcgttgtttggcggtaatgtgcgcagttgaggtccatcaaagtactccaaagatactgaaggtagcacaactcaaagttcagcatgtttgatggtttggtgaccttctatcaaagttccagccgcggacgaccgtcatcgatcgttccgagaattttaggagccccaaatgcgatttcaatatataatatgtctatctcctggtatattaagccagctgcagcatacagtggcctcctaggtgttcctctaaattctgtacagatggaattcgagaaacggctatctatatgggagggagaggcattccggcgagtgcctaaagggccagatgggaaatactcttccaaccaataccgctggattatcaatatgcgatagagacctagattattagttatagaagcgaatatcgcgtttaagaagagggtatctgaaacatgtgttgtggcttaacgatcacttagctcacgaatcgtgggttcgaattgagccatgctgcaatcttcttgttgaagcagaataataaaggattctatgttttttgttgttgttttctcccttttcttctttttccttcccgtcaataggtgataagagactgccaacaatttgttcatacaatggcaatactcgggcacgtgtagctccctgattcgtgtttcccatagcacagagtaacaaggatgctgcaggtatttattcccacttaggtctaggttgaaatgtaggtagaatactatatcattagaatcgaggagtttgtcttttcattaaccatcaatcgtgctgtccttgcacatatccaacagctgggaatgtatatgagaagcaagtctgttttcctcaatctggccgaccagtactgcaagctctcgcctagattccgtgtcgatgttcgcaggccgcgcagctctcgatacactgctcgcaagaaggtccatgcagtcgcggtacacgtctgcattctgcgaccggtcagcgaatatagagagtattgccgtgcattctctaatagcacgatcaacaccctttgataccgtgatggcccggcgccagacgatgtatatcatcgtgacccctatttggaaaacgaagagcatctaaagaggaagattagtacactgttgcctttttcttgtcgggtaacgtacatcaaaccagtgtctgggcagatgttttctcttttggagagccctaaaggttgcacaggcgtcacagcaggcttgaagaagctcatctacgatttccgatgagacctcgagggagacagagctgtacagtaggaatcgggtcatgtgtccgacgtaaaccacgccaagagggcttgcatgcccctccctattcggatgactgcttttgttgtcagccgcccagtaaagttgcaagttttcaaagacgtacccattggcgaacacctcgtcactcttagtccatctgtcgatctctacccgcaactcacgtagacgtgcggtgtcgatgtcgggagatagtccccgcattgtggtaagtatctctgagtgaagccgtctgatcctgcacatatgagcgaaataacgtagatcaaaattgtacaacgtcccgtctgagaaacccggtaagtcagcagcccagggcatgaagaattgaggatcgggcttggcctcatatgatggtgtctcaatccattcgtctggcggataggggggaatgcgtagtgttatcgccacaactttgtccaggcttaatcattgttagatagatgctacccaggaacgaggtattaatctcaccagtatatggaccaccaagctttgatcttcatatctgcttcgtgagtcccatcattggtgaggcgatgaaagccatgcaggatggcaaaacgcatcgccaccccgatgatatggacgatccgctcggtgttttcgccatggagcgcgaggaacgcgtggagaagcaaaaactggattctccgagacggtttcaaagagtcatccgacagaatgctttgttcttgaacatcaaatccctggcgctgtcggcgggctgtgtgatcgagccatgcgttttgtaggatggcaccattggcgatgatctgcacgcgtgagtgaatttgagccatgaaagcaggctgagcacatacaagcttgagaagacacatgggccagtctttgtcgttccaggttttcatctcgcccgttttccatttgagatatgctgtgctgcattcctctacgtcaagaaaggggtagcgagggtggatggtctcaaagtacgtctggaagaacgaagcgccttcacgaaccgaaacatcggccattgcggcgtcccctgatgcggctagggattgcgaagcgtcgattgtgtagcttcctggttctaccgtgttgtttacttgtatggttggttcctgggcgatggaaaacaagttttcatctgggtatgagaagtcaaagggaaaggctgtgttctcgcgggagtgtattgggggcagatagaatgcgtttataggatcattgaagccctgaacctctgcgtagatgtttgattgtgtgtttggagccagaagggtaccagcacaagtatgaacttgggccgctgtctcagaagtctgttgagggaggcgagcatgaaaacttgccacctgttgctcaagatcctcaacatacgagaccgagtacgtgtcagtaggcccatgagtagcgggtacacattctaagaatttccatttagcagctacaaaaatacatcagtgagaaaatccagatgatgctactgaccagctttggccgacttgcagttccggcaagcaccatcctggtcctggccatcgcaccgctgctttcttgccctacatctttgacaagccgttgctttcttccgccgaagtcttggcgtcctcggctggtctggccgcatgtcgttttgcttctccaaagacagctggtccccgatgaattatgacagcgggctggaaagacttgtgcagaggctttttcgtccgatgactcggaaccggccccgctcttctcgcagcctttggcctctcagcattcctgtaggctttccttcggctttttaccccgatgactcaaaggtccttagcagctattaacatgctccgaaaagccgacaagtcataatatcgatggtaaagggtttcaatagtacctataaaagaccccttcgctccaatagccagcaatatattacgaattcttcacatcgcttcttccatttaccacgtcaagttgtctctgtttcttacttacctacttgaccatcacatcagccgtaacgatgagaaatcagctaagctacccagccggcgagcaaaacaaagtgaaccggctggccgaaaagcgagcggcgtacgaccttgagacagtccatggcatcatgaaccaatctcttgtcttccacgtctcgttccaacctgacgccgaaaatgcattccctagtactatccccatgcttggcgccctgggcaactttgactatcccagcgctggcttgaatgagcctcaagacgcctacatccatgggtacatctcggcccggatgacaaacttggctaggaaggcaatggacgacggactccccggcttgcctgtctgcctctccgtcgccaaggtcgacggcctcatcctatctctgagcgcatttacacactcgtgcaactaccgctccgcagtcctatttggacacgcaagtctcgtcacagacgagtcggagaagctctgggcgctggagatgctcaccaacaagatcatccccggccggtgggaccaggtccgccaaccccccaacaagaccgaactcgtgcagacgcagattctgcgggttcgagtcaccagcggcagcgcaaaggtgcgtgcgggaccaccggcggatgacaaggaggatgttcagaatgccgcagtaatggcgaaggtgtggtcgggctatattccgctggtggagcgcatgggagagccgattcccagtgcgtacaacaaacttgtggaggtcccagagaatgtccgagaccttcaggaggagttcaacaaggaggcagatgcgtataacgagaagttggtcaagcaggtggaggaagatgtgatctcttgggggacgatctgataaattcgctgccatcaccgtatgtcttttgccgcatgggagaatcagccatgatgcataggaggcgcagagaagactggacccgtggagagatcgggcagaagtttgttgagagacagcgttctccccaggcttgcctccatactccccaaaagtctagaagcagtcaaaccggacagtgttcctggtctccgcgttttagctccacggaagagaaaaaaatgaagttcaacagcagtgaagctgccagagcaagacaactcgacccaacacataagagaaagagaataaagttcaacagcaatgaatacgaaagctttaaaatatagcctttcctagtccgcccaagatgtagtcatacggcaggaaaattctactccaggcatgtcacgcccgtatcttccccctccaatcggccatggcaacgtgcctccgattttgccccctctatcttctctatctcctcccagcctcggccagggtcgagaaagccatttggcttgagctagatgagtgtatatatatcgttgccaaatcacccgttggtcagtgtctgtccaagcacacacccgatgctgctcgcatcttgtgctctatctggatttgttgtagtgaaataggtcgaagaacctcagttataagctgcaattcaataattgcatctccatgcgattggatatccttgccgcagccaataacctccttagtaatagtccattcagaagaagggcgacgcatctgccaaacagacttccacgacttttttacattagactcgaagtccatgtcccatgtcgccctccaattaataccatgatctcttcggtatcgaaatactgctgctattccttttcttccattccatatttccataactcgcagctttggcatcctcttcaccgcacttgcggctaattctagcatactgcttagctcggttgtacttgcctctggcataagcaggtttgaagtcaagctaagggagctaagacagggccaattcgtatgcccggtagtaatggtgaagaagtcagtggcatcgagtataaaggatgcggataaaatgtcaagcttcaggctggcaaggccaattgctcgacccacagcagaggatgggatgcgaagagcttcagcatagtaaatactcgctggatattcttggttgaagttctcgaaaagtacaagtcgtttgacatttggcagcgacttgaacatgcgctcatacgctattgattatttcagaactttctcctttctctcacgtagtatagtaggaagaataacttaccactatctgtaaatcgctcaatagctctatcccattctctccaaggttcataatgaatctcttcaagtctgggaaaccgagagaacagcctctcaagggcagctggtttccatcgccgtctagtctgttgacgtaaacggattcctgttactgctggaataaaagggactttgctccaccactcaaattcttcttcttctgaatcaaatggacccctctcccatgatttcttcaaaaacgttttcaatggcgtacgactctgggaaagattcctgataagcagcattccaaccatgctgtctatcactagactcatgtagagctcttttcttttctttgaggtattggtcaaagttttgaatagaaacatcaggttcgaaagtcagatatttgaaccagtgttctgagtcgctcggtgaatatatgctaatatcaagcagtagattggacgtgtcttgctcccacgtactaagagatgagaataaattttcgatgcatgttgtaacaagacgattgtctttatatgataatccaagcaattcccttgttttgcccttgcacttcatgcaatcatatgtttcaagctctatagcaaggtaaagagacttgacaaggtgtcgattgcggtgcgttatttggttcaggtctgcaagacgagaaactgtcaatgtaatccgagaaaatatatgcggttcgatgacactctgccattctcgtgatactgtgacaagatgggctaagcgacagccatccgataccaaggcatccaggaccatgaggcggatttccggggctagggagctccaagtggccatattggcggggaaaccctcactgtgttgtctttcattgtgtttaaaggttaaaaagcttttttttgttaacgttatcctcttttgaacactgatttcttgcacgcctttccctcccttcttgcagttaatcttattgcctttgagaaaaggcactgagatatcgttatctgccatgatcctgatcgtcgggataaacagcggaggctgcaggtgtgtcagtgtcagtgccctggccaaggggctactggtactcactgggttggttggtatattcgcgcttggtgtgttaaagtgtttggattggcgtaagacaaacgaaagaacctaggtgaagagggcagttttaatagttattcgacgagcagttcgtcctgacggcaagtgagttatcagcatgaaggtttatcaaattttctgctgtatggctgcagctttgggctagcgaagcttttattattaacctttcatattcattgtgttgagttgttgggtctgacatcttctttttgatttaactttatatcaaactctctacgggggaggaaatgacgagctaatgaaaagacccattggggaacagaggtggacgagacgaaggctcttcgtatgtcgcagttgaacgcattgggggagaatgctcaataacaagggaggcgtagaatcagcagcattgtgggctttagatacttcatgtctgagatatggttagggctgggccatgactctacaatgccggtgacttaatgcgttgcgtgggcaatgtcatgatcgaggctcttagctcagaccttaaaaaccaactacagagagcttcaatggtgtactgatatggcttgaccatcccttacgtaaccgtgcaagcacacaaggagatcgtacgagtaaatgaggtaatcatgaagtacataaggcttctagcaaggccggagggtaaaacatcaatcatcattatagccttattatgtgaacctgcgagtccttattgctgcttcattggcgaaccaaatttcgtgcaagtgtaacccggtatcagggagtccctctctcaagctctatctacaccttcaccttcccaacgagactcgcccgtccccctgcatcttacgcgtccacaagctggcgaacagcagcaaccaggctgtgcccttcattgaaaatagctcactacagagaagatctcaggtggcaaatgggaatgtcctttatttattcattataactacttattcattgacaaccagactggaaagtaaaacaaggttaaagtcagggtccagggaacccgcatgcagcatcgtgccgctgcagacagcgttgtggtgagcactattcagatttcggtgtacttgagccttagttacggcggcgatgcccgattcaattctctcgtaaatgggattgctgtcgtgaaatcagactaggacctcggtatgagagccgcgggtgatgacttcgtaggttcgatcagcaagggtatcgtcggtcaagcatcaagtatcggctacgtcgactttatggagtgaggcggtacttggctagcgctatgtaagtatcgggagctatctctttataagtttcgcctctcaagtacggagagtacgatacagcagtgtctcgtcgtccaacacacgtgtataagtacctggtgatgcgaagcccttgtttctacgctcgtcccaacttatttgcctatatattcttgactgaaggctttgggctggtctggtaatcaaagggggcaagtgggtgacatgagacattgcacacccaatagcactttgatcccccatttcgccaaacccttcacttcaacagctcaataactcaataataaatatataatataccctcattaaagataagagtttattatttaggcctctaaaagttattgtatagttttaatctattattctgataggatttagctgttggactgaggatcgaaaacgcctatgatttacgtgtgcaatgacttatgtcaccaggttgactggttagattgtacttatctccgcgtgctgacatcaaattgaataagcgggtctgctgacaaacgttacattggcaactttatcacatcgaattttcccgctggattagtcttttcctgcccgacggcggccaaactcacagttttcctctgcagcgtcgagtgatagggacggtcgctagaaggcactgtgatgatggattccgggtccccaattcgtcgacgaccacttcggggcaggactgccacagcttgcttggaatgtcaacggaggaagaagaaatgtaaccgtcaatggccatgtgatcattgtcaagatcgaaaaatctctcacctatgcgagtttggaccacccaagggggcaaggtacgccgtttaccaagtaacagtgagaagttgacgtgtgtttcagttcagatcctgatgatcgcctcaaatagacatgtagtggagtcagaagcaagctcaatgaacgattctcgacgaaccattgagcctcaggtacctgagatccagaaccctttgtctctggaagattgctgcttggctgtaaatgagttgtcatatgtggatagtgatattttcagagtgcttcaggcaagtgcttcgtttttgggtggatatgccccatcgacgagcggaaattaacatggagagccagatccaatccactaccaaaccgacgaaagcgctatcagttccaaaccatgttttgcaagctataagaactgtccccccacgcccgtatactgacggtttggtgaagaacttcttcaatcttgttaactaccactattgcattctccatcaaccgcatttcatgacccagtacacgaaatggtggtcaacaagacctgagcttagaggctcgcctagctgttctgacatttctttcacttgcctggttcttcgaatatgcagcaattcgacccagtttcttacgccttcagatatccatcggtttgaatctgaacttggagaatctatatcggtcttgggggcaaattacaataccgcggcccaaactctgagcgattacctgccttctgggagtggggggttgtcaaatgctcagcaactcttcctagcagctacttggtctaaagcagaaggtgactttgtctcttcgtggcatcaattggctgcggcggtaagacatgctcaagaaataggttcgtggcggcttattgttacacattccagtcaagaaacctcactcacaagtttttggacaggcatccataatgattcatcgtcagacgagatgacagacatggagagagaacttcgcagacgactttggtgttctgtgtggacctgggataggtgagtagggtctcgcagaattcttagtcgatggggcttttgcaggattaatccgtatttcgcagattcatggtcggtattttcaaccgggcgtcaattatccaaccaaacgagcctgtccccttgcccaacccgaagttggatcagacacgggacgatccagagataccgtcaattgtgttgactaaggttcttgagaatcagctaactaggcaactgtatgatgatagccagaaggatgccgacttggatgccaaactggccttggttgagaacttcatggacagacttcccagtgttttccggcttaacggcgccgatgtacgatgggatacaaaacatcctagactcgtcgcccaacgcctacaattacatacaacttgctatatggcccagatgatactgctcaggccaacagttctagatattgaaagatgcgacccgaacaggctctctcatacaatcgaactcagcctgaagtgtatggaagtcagccgaaagttattcgatgcttgcgtcccacagcacgcaaagtactttatggttacattcgccccttttgataatgcatcctttcttgcttccattgtcatcaaagccggtagaaaacgccaagtgcccagacgttcagaggttctagcagcaattgggcaagcaatctacatgtgcaataagctacgcgaatttacgaagctaggggcaacaacatggacaattctaatggccttggcttcgaaattcatactcgatgcgtctgagagaaccatctttgagcagataggacgaataagagacgaatcaggtccaacagagagaccgtttcttgagcctgggataggacatgatgagcctctcatccgccagcctgatagtatctccaatttggttgatatatctgagactgattggggaatgtggggagcatcagaaccttcggcgcaggttgacctcggtatccttgacgggatgtgggattggaacggtctgggtttgggtgacatgggctccggctaaattcatgtctgttctgggaagagcaagcttctgggtcaataaggcagcccgttatggcagcccgttactcaggtctctcatcgacgccaggtttgaaattatgaagaccgatatggccatgtctgttagaactccgcttgggctctccaagaaagtcggcggaaaacggatgagaggttatgatgaattagcagtacttgaagaattcacacctaaatcgaattggacaagcactcgttgaatgacattctatccttgtccaagtctatattgttctttcatggcttggtttattccgataacagaaatccagcgcaaactatttaattccagttcaaatcgttattcatcatgtccgagtcgcgctcagtcgcacaaaatcaaggctcttcatgatgcaccgcctcatccatcttcttcgcttcgacgggaatcacgggaactggaggctgcttggcaagcttgacagtggccatagcagaaggagcctcagtgaagagagtctcgatctcttcaagagaacgtcccatagtctcggggaagaagaagtaaactgaaagagggatgcaagctccaactgcggcgaagacaataaagtacctccacgagatagtatcaatcgcaacgggtgtgatcatgaccacgacgaaattcctattgtaaggtatgtgtggttaatgttttgaacgtgagattaattgcatttttagcaaagggaacaacataccagagccaatggttcgctgtggaaatggaagacatcgccatacgcaagcgcaggggtgcaatttcagtgcagtaaaggaagttggcaccaaggaatccgatctatgagcacgttagaagatgaatcaacccaacgaggaagagtcaatgatgatgacttacgggtacaaatgtattgaaaaggtagatgaagcacccagcgatgatcatcgcaggcttgttctctttatccatcgaagtggtgattgccagggcagtcatgcaacaacacatgccaacaccactgatcatgaaaacagcgcgtcttccaaatcggtcgatagcgacaaacgcgatgaaagaagacaaaaacttccaggtcatggcgccagcagcgaggatcttggacagctcggccgacagaccaatgttcttcttgaaaagaatgggaacatagactgagatgaggttggaaccggacatttgctgatagaactgcaacaggatgcatagggcaaatctgtagagcagcttgtccttgcccatggtcatcatgtccgtaagcttagatccgctgaccttggtctcctctagcgagtgttcaatgccagaaacctcagcgacgacttcgacggcatcctcttcatggcctcggaacgaagctacgatagatcgagcttgttcggatcgtcccttcatcacgagccaacgagggctctcggggaagaagtagacagagaagcagagcatcaaggagaagatgatggccaagcaaataggaggtctccatgtaatcatgccgtcgacgaattcgaaaaatcccaggttaatccaagattccaaagtgtagccgacgcagatgaagagaccgtcgagaacaacatgctttcctctattcttggcgccggaggtttcactctgccacactgggacaatcgaactgaggcatccaacaccgaagccgatgagaactctgccgacgatgaattgggcgagcgagaaagccgaaccctgaagaacttcgccaatcagtgtggccagaccgccagcgaagatgacatttcgacgtccaaacttgtcacctgtgtaagagcaggacagagagccgacgagagcaccgatggtgaatgtggcaacgacgaatccctgaagtgtagacttcctgctcttctcagagccggtcgagttcacagtatcgatctccgggaacgtcttcacccagtctgattcttccaaatatcccccaatgttggcttggttgtagccaaacaggatgaaagccggagcgacgatgagaaagagctgaagaatgctcagggcgttgcccgagactcccaagtatgtccgcggcatgctttctcagtgttgggtatggcgtatacaacaaacaaccggctgtgagaaaggcagagatggaagaaactcgccacggccgagacgagagagagcacccaggccggccttcttgtacttcaactccaggaggggaaacaaactcctcatggagccccgtgggaactcaactttgcctccacagtggttagcatttcaaaccatttcccctctttcctccaatttcctccaattttactccaattttgtctccctgtcctcaaaacccacccaaatctaccttccggatctcagtcaggagtacctgttccgtccaagccggggaagccgaccgtgcgcgttgcgactttcaccactgtccgatcaccgcgactcgagggattttcgtaacctcgcaagcggagccaatccaccgtggcatggtgcccgtcaggggcacagcatgaagctatcagtgaaaggtttgcgacacgagccgcgggcggctatgacggcacggagatgttcggtgagaaggcttctagcgcagcgggattttttctaaactgccgggctgccgtcatagtcggcatcagatgtggacctcgatgcctgcacgataccgcttgtcagctcctagtggctcggaaagtggccgtctggcagaatcaggcacgtccgggcccggttatctcgaagggttctgggtccctcatcaatgccggtgcgctcgttggcctgtcaccccttggcctcaacgccgcaagcggcctctatgttggccacgcggcggtgtcggaagcttgtcgatgtccacaattcacgacgtcaggccagtttccactggaaaactgagtaccggcaagtgggtgacattccatgtaagacgtgtcaccagaacgcttcgagcggcatctgaagacatgagtcttgcattcttgaattggcaagaataatcacgtcatctactggccgatgaatctctacggtgctctactgctttcataaaccaagttttgttgttttcatgtttcattgtccggatttatgtcggactccaacaccatcggggccacaatttgagccgtccgcttgactgacagggtggcctgtcaactggtgtatttctttaacccaatcagcacaagtgaggctgagtgggcttgattgaagtaggatccgccccaaaaaaaaacaaaatgatcacagtttggatcctcttactcaaccttaagcgtaataatctcgagattctgccccatcaatccaaagtgagagggtacatcatcacgtcccccaatggcatagaacctattactgaaccatcaatgtccataatatgtaagaataatccgatgctattagtcaactatcgcatttgtgtcattgctgagatccctccatcagggtcttcacccttaatgaggatgctatatacaagtcttttcagcaatgggggtctagtcgagaaaattaaacgcgtgcacctgagttgtagatgacggccggtcccaattgcatacatgcattcatatggctgtgaaccggcccgtcgtcgcctctcaaggcgtattcaacactactctcacccctctctgcatccttgtctataaccgctgcacaattataaaccgggggcatttatgatcaacctaccctgggctgaatggagtaggcggcaatgttctgaccgatgctaatttgttcagtgaactgctgccacctagattcccatacattaaatgatgggtattgacttgaactccactgacccagtggaaaggtagtaaagaaacttttatcaagttaggggtcgtttcacgtattggataataaatatcatgaagaataataaagaagaatcggatgaacccacacgagaagatatttgtcttcgggctacgcgtaagtctgggcaccctgcgaccaaaagcagtctacatgatcacaaagtggcgaacgtagctggctgagattcgctatctcatttgaacactcgggagttatgcatcctttattaattgtcttctaatatctttcgctggtaagccgttagccaggcaagccctcttcaccaacggctttgacgtggatcggtgggaggttccatatagggtaggccgggccggatgatgaacaaggtcggccatccgccccatagcacgatgtcatcagcctggggaaaatgttgatgggtggattttgccacttgtttttcgtgttgacagatggtggctaatcaggttttgttatgactgacaatgaaaatatttgcaatggtttgtgaatcactgggttccaagctttttatctagagattaaaagcctttaattagatgattggttgatcactacgatttgattccatgaaaacagttcagaacggttagatacctatgtaactgagtacactgcagtagggtgacgcaagagcctgacagcccaagccaatgccaaccatccgagtgcaagttagtgattgagagacagtatttatccgacaacggtttcgttatgtcattcctttacagcttggacggagggttagcggcatccagaactgcctggtaagccacattgactctctcgtgaagagctgcaaattgatcggcgtaggaggggtcgacttagccacggattagaaaagaaatttcaccaacgatgaattgatatgttcacttaccaacattggcgagagcagcgaagagcgcatcgacatcctcctaaacatgtgttagcaagtattatgtgagggcatctggaacaggtagtaccttgacgccagcgaggagatcgaagaacagatcgaagtaaccactatttctaatcacatcaatctgcagtatatattaataacgtgtacatttctgcgcgtcagtggctcttaattatgaatgtataccttgataataacatttgcgagaacggtttcaagaagggagacagtgctctcgcccgccgtgttgagagtggccgattgagcagcagtcaaggcaccattatcgataacatcttgagtagtacccttgaggagggtttgaagggtcgtaatgtcagagtaaagcgaaaggctctcgcccaagctgccagtatacgcgacaaccttggtgttgattgaggtcagtgtagcgtcgatctgcgtgaaaccattctggatgtcggcgaagtctcgcttaacgggaacaggaattgccgaacccaaagcaacaagcccaagagtgaagatctttgcaaagagcattgtggtgatggtaatgaaaagagtagtatttctagcaaagcttgaagttgcaagatgcgatcgatgtctgcttatgagaaggtacgagtggaattgatgatagcttgggaagatgaggtctatttatctttggctcgaaagcctcgaagccgatcaagttgttctcataccctctctgaactcctgattacgacacgtcgcaatgaataagcttgtgattcgccgcgcttcctcggaagaccttcatgtgatacctgatgtatttttttggtgttccaacttcttactgcgggggcgatattgcggaagccgagtcactttcccattatgcttgacgaattatacgggtaaggcgcgatattcgttgatttgttctcatcgcggagtgatagcctacttaggacatgacatgcatcggaaacgggaaaataaccttgcggcatggattagggtagtctgccaacagagccattgcaacacacatggttccccgtggggaagctttaatcatcgcgtggtagtattgagatagagatctacatggtcctttttgttcgaaacagttgcatcgaatcgcctaagagcattgtgacactgcctttgacggtagtctcagccgagtgaacccgatttggtcaccatcgtctccgcataagacgaactgcagtgtgcgaactgtcgtggatacgaccacaaaccgatgtggctcaaatgacggccccgtactgcgtggtcaatctttgaaagcggtcaaggccgttaatcgaatgagttgcaataccgagttcctcggtattgcagctcacagttgacttctgcattgactcgacttaaagagattctgttcgatagggcttacctctaagaccaaataaccaattggtcatctagtctcacgcgaaaaagcaatttgcgtgtatttttgatgaaagttgtcgttggtcaggatttatattaacttttaatcaaacgcagatatattcatactcatttgagttttctagtaatttacacgtgctcgcccttttatcgatgtcacaagctggacgctgaaatgccgacaatttgggctgaggttgacaaaccgactcggacaaatggaatgagaactcaacttgcttgggaaatccgacaaatgaatgacgccggtttggtagcactgagtcgaatccacgttcaggcacatattctaatcaggctattatgtctcagtcggctagcgactgtgacctaactagggtaaccaggactaaaagcaggcgtgctgctgaccagatgccccctgaaacgtcccattctgagatggcactctgtagcgggggaagagagtggatgtaactcatctgttcaggagttgccgggtgcacggaaatctcaatagtcaggtaggcggttaagcgaaaggcgttcatttcacaacaactcctctctgacatgcttccaagtgcatgcaccatattggtattatgtgactgaacataagaatatgactgcggtaggcggggaatatgcatggtaggggtttacattgggttgaaattgtctagacgaagttgggaatgttgcatctcggcgttgtgaccccgccatggtaggtggccatctagcagcagtatttggatttcattagctaacgatattatcaattataatacgggatataccattctctccggctgtagctgaacttgcatgtgagcctgattgcttcctctcttccaagttgatcaaccgcaagtatctcccgttaagcctgggaaatagcagccatcacaaggcaagactgaactgggattactccgaagaggataccaagaggaatcaaagaaggtgccggccactgaagttttaggattaatttgacacatactacgtatcaataacccaccactacgtacttgactacatgtcgccagcttaggaatatgtatcattttattgaaaggctgagtcatcaaatcccatcccctgtggcccagctggctaaggcgtccgactgttatacactagcgcaatcgggagatcgacagttcgatcctgtccgggggagattctttccttttgcctttatttttggcaagcttttctagtttttcgattggggaattaaaaagttccctgaaagacctctgctgtctggaagttgggacatttgcctatgttgggtgccgcattcttttacgaggacaagcctcattacatcacgacgggcaaggcataggatggtgataattaccttactgctatgtatgctataccatagatctataacacatctctgagaaattttgcatggctacacgcatccctgttggaatgtctcaatgtgggcctcccttttcctcatcgcttgttgttccctcctggttaagagtggcagccacatgatctgtcatatacttctccgtgttcggtgcgaagaatgtcagaataatagccagacctgaaaacgcaatcgtgctgaggtataccgtccgatacgcattcgagttggccaccttgtaggctcttaccccaacagctacaatattatctgtgatgccgctgacagaggcatagacactgctcggtgcgcttgtaccggaagtggagatgatggtcaagaaatcagacacagagtcggctggtaaccctgcacctacgagagcaggtggaaccaggctcgcggttgtttgagtcagccggttgctgaggatggttgtgtagatagcgacgaggacggcacagatagcagcgcggattgatgctcctagcccgccagcaattccgatctctctctgatcctcgacgcagatcgtcgtgttggccagggtgattgtctcgttccagccgatgaagaaacacccgagaaacataagagaaatagcagtcgatttattatcaggattactcacggcgacagctgtattaagaaaaaagcagttagctctcatgaaagcgtggccatgtcagagttagcacttgccggcaagaaaaataccaccaatcgtgaacacagtcatgcattgatacttcgccttgccaatctttgctgtgagaactccgccgacaatctgtccagaaatgatgccgacacccacaagcgacgagatgcctcccaaataactcaaatctcggtcattgtaaagggttgcgcattgcatgggccatatgatagcaaaggcgtagtacacaccagcgcccagcccgagcagcacgcacgagaccacccattgcgtgttcttgaacagatgcatgggaatgaggggttccttgagtggtgcataaatctcccacaggacaaaagctaccaagacaacgaacccgatgacaatcgatgagatggttgcggctgacttccatgggtagacggcacctccccagctaagaccgagaagaaagacgcaaaagccgctggcgagcaagaagaatccgacccagtcgaagtttttgagccaatacagaaccgacgaattctcttcattgcggtgcttcttctcaaaggagggagggaagtagaacaggacccagcagatgagtgctgcgccgttcaacgccatgatctgccaatataggcctcgccatccgacatttgggtaagactggatgaatccgtagtcgatagacggggcgaggccagatggaatggtgaaaagatataggaatgcgttgccgacgtatcgccacttgaggggaataagttcgctgcattgaccaagaagtcagtaagggctttctcagactttttccataataaaggtagactccttacccaagcacgaaatggaaccccatctgggtagcggagcagatccccaatagcacgttaccaccaatcaacatgggaatggaagttgaggtcgcacacacgatactcccagcaactccgatcaagcctcctccaatgaagaagtaccgacggccaaaaatatccgtcaaccgcccgaggggagcaagaaagatagccagagccgcattatagacaagagaaatccatgtgtatcttgcatccgggcctagatcagcgttgatttgggtaagaatgggcgcagcatatccctaaattcacattggtttctgttcttaaatggtagtttgcttagtaggggacatgcgtacaaaagatgccaccgcggcccaaagtcccagacctgttgccagaagcgatccaaggaagaaccggctgtagtagtagccttttggaaggtgctgaaagtcagtttcgcatcccaaagtttcatgttcctgtatagaaacagaatgggatgatgggatttcggcgtgctggtgcgatgtcacctcttctttggaagagttagccatcgtgctgggtcgaggtttggaactctgaggaaagaattgatagcacttgaaacggctgcaacccagatggatgaaacgaagaggtcagaggatacagctggatgccagactttatgggcacttgatcttcagccaagatttaggtcttgacacagtgcaagatggccaggttccaacaactgtagctgataccgtgccaacagggaacggctgaggcggactctttcagggaaacaacatccgcacgagccggaaaattcggctccgcaatatattatacaattacactgcatcatacatgattcaagccatatactggacgtatttccttgttttctgcaccgccttttgccaagcttgtttatcccttcatccgaaccgccttctctgacgacagtgatgcatgctcgttgtcataacttacaagataaacataaatatgtaaccatttcccgtaggctatcaagatgaccccgatgaatccaaattccactagctagtagtaatggctactgggggctgggctgccgcgtcccctgaatatccaaaaatccggggtaaaagctgttcatcaactcgttgatcttgctcaaacggtacagatccttgtggggagattagcctttaggcactttatgcggggaaaagaacagaaccaataaatggaacgaggcctagactgcccaaagtgtccgcctgagcctcggtcaacgttttccgctggaagttcagtttcctccggaagtaaatagcccacataccaaaacgcgaggccagtggtcaacatgggttgggttcagagttgattgagcgccaacagctaaattctcatttacagcacagccttgtgccagagtatctcaaaccgcactgctgtgtctgatgcaggcatcgccaagcaactctagcccgccgaaaacaattctagagtaacatcgaaaggggcagagatgtgtcgctttaaattatggcagtcagagttctcctggtcacgtttttagattcagtgtcttatcttttgtggctgttgagttgcttggaagtgtcgcacggcaccagactttcgcgtacacatgaagacgcattttgagtcagaaagctaactaaggttcatctccccgtaggcatcaactaactgttcccatgagataccagggccatacattaaagctgctaccaatcgggcatcaaagattgcgcggtgtggaaagctgtatgtacagcgatgggtgatctcagctgctctcgttcccaaaatgtcagataagaagatgctattctccgaacgcgtcctaatcggggattccaaatctcgtaaatgtgcaacaacaagcttcctaaaatttattatatcttgattttcctcgggagatagaccgggaaaagtgatgaattccggagagacaagggaacagtttgggcactatcccagtcaattataccagtaatattgtactcttcatcgaaaaggatattgccgtagtggaggtcagggtggtacagggggaatgaaccatagaccctatcctcggagattatatgtgatacagcagcctttagaatccaacaagctgatatccattgcctatcgccaatgtgttgggctatgaccagcctgttttcttgttgcctttcattataaaaccattctagggatgttgatggttgccgacgtacttcaggatcgagaggaataatctcaggcgactgatcacaattttgaccacatgatattcgaccaagggtatcaaacgacaggttttccagttggaataatatcttggcgaactgagatgcaaccttgggtcggaactgaggtgggatattttttgctaataccccctcaagagtttggcctggaagtgcttccatgagggtgtatgggaacccaaattcattttttgatgaagtggaaaacgcgaatacacatgggacaggtattgttgtctgggatttaagcgtcttcattgttacgatttcgcttaacatgtccatggcctgcccttcactctgggcgtcgtcgattgaagaatgtcgtattcttgcaagccaatatacttgatctgaaaaggccacctctattactacatgatgagagccatacgtaaacctttccgggtcaatagtacaacagacatcagggctgcaaggctctgctccagattggcgggctcgcaacgccactccttggagatactgaaagttggcaattgttaggacattaagaacttgctgatcaggaggattaggtctgggaccctgatccccaaacccgtcccaaaggttgcttgcacggtatggcatgtcgaggtgttcgtaattttgtcgagcggggacgaatcctgctgaatgagctgatggtatgctgcttgaaatacaagcaaaaattttgtggtggggaaactttacgcattcgtcagctcttgatccacgtgatggccttgtaagaaccaactgcataattaagatgtagcgcctggtagttcaattgttgtgcctcgtgaccccttttgggctttctcaagacggtggaagagacgttctcaagcccttttcgtctgggcatcgcaactgtatcgggaagaagttttctcattcctgcctggttcatttattttcgctttttgattgtttgagctgactataaatttggcatcagtcttgactattcagagatgcgtcttcggatgacgaagttgccatggaagtttgatcttgaaacgatgctaaagagcgacgataggttcaattagagcgtctacactgtatggaaaatagaagtcttccaacatcagactgacggaagctgcacgtggcagaaaacaggagtgatagcaaacagggtattgttcccctcagttcaattgctaagggtcaactttgatgtagcaaatatgtagaattctcccagggtttctttaccctccaaattatcttgcaaagttgggaacaatacagttactagcagccggtgggcttaaagcaacctgcgatggacaactcaatgggtatacgaagacatctataccagataggcttatgttaaccgtgtgatggaatcctcagacttaactcttctctttaagtggaactttctcattctccctcactctccgatatctccggagctgtctcttcactaacaattatagatcatgcctgtcgatgagggtcgtttattgcaacgaattcctccgggattgactttgatgcggcaacccgacactattccatgtttgggtgtaagccgagaccctgcaagtcttaaccaccgagggggctcggatccaaaggtgctggtccaatcatccgcgtccaatcatccgcgttgcatccaaacaattcaggcaggagaattgaaacattaccgcctgtcttgaacacatataaatatcactgcagtgatgaaaaggagtataaatacaagaggtattcagtcttgctctggctcctgaccatcatctaaatcatctattcaatcatctaaatcacctattcaatcatcttctacaacccgctaaatccattccattctcaccatggccagcaccgcccaaaaactccgaatcggcgtcatgatggacacagttcagctgtccgacgtcatgggggccgacatcctcgccggcttccggctcgaaacaatgaagcaagccgccgcgtttgctccagagctcgtcggtgacgttgtacagtacgcgcccgacatggaattcttctttctctctaccactctcgatccaaccgagacgacaatggggctcaagtatgcgcccaacatgacatacgacgactgtccccgcgacctggacattgtcctcatcggagggccctggccgacccaccgccctaccgcagcggacaaattcatgaaggaggcctgggagaagacccctgtctggctgaccacctgcactggaagcctgtggctggccagctctggcgttatcaagggctacaaggcaacgacaaaccgctcattcatccccacggcccagcagctcagccctgacgtggaatgggttacccagcgctgggtgacggggccaaagccatatactggcgggtccagcctgaagcccgcattgtggacagcaggcgctgcttactgcggtatgtgattccttcctttttgcctttggtttggttcgctctgctaacacctgatcgtgtgaaggcattgacatgattgtcaagttctgctacgagaccttcaacacccagcttatagatcttgttggagaaggaatggggtttgatgcggattccaagcgcggacaggactactgagcagattctgtacaattcatcggctgataacgtagccaccatggaggctcaccagatagctgtggaacaataattccctggcataacgtaacaaaaacgtagctgaactgtgtctcacaaatagcgttatgccaaggcgttagggttggtgagctgaagctgtgctcgagactagtataaactatgagggcatccccccagtccatagaacaaaccatcgacaagtatcaacttctccagctacatgatatcaaccaatctgcattgaacatacgactcgctctcctttgctgatcctaaacaaatgaataccatggcaccccatcccacggccacatcccccatcctcagcgaccgcaacaatgtcagcactgccccaaccactaagctcacatcctcgagctctaccttgatctcggctctcgctgccagtcgctttgtcctaggcgcagccgctttcctcgcgcccggggtcacatcccaactcttcaaagttgacactctcccgggcgccagcctgataacccgcattttcggcgttcgcgagggtgtgctgggcggcctgaccgccgctacatgccgcgatcacgagtccaagaaggagctgcggcgcatgctgtgggctggcgtcgccgttgacagtatggatgtcgttgcttgcttgattatactggcctcctccgatacgacggaggcagcggctgcaaagacgacggctattgtcgggctcggggccgcgctgtttgggctgttcacgattcggtctgtcgactgggcctaagcgcacggagtcgatgtttcacggaagttgtcaaatcatgtataagaataacactcagccgattaaccaatctctctaaccacactttgcaatcacagtagctaaaggagaaaaccaataatacaagctgcgtcatcattgcactcgtcatcaacgtcaatcatcagcccagcaagctatgaacacctgacgccgtcaagatagaacccaaatagaattttccccaagccgtacgtaacgaaaaaacataccctcctcatctacgtttaatgcccaatgcgtcaatccagacacgggacaaaggccatcaccaactttctggccactaaccagtaccaaagcccataacgaaagaaagccagtcggcatcatccgactccatcgagcttgccacagccatgatctgctgcgagttccattcatccggttgtgttttatccttactatcctccccgtacatggacgcatcgtccaggggcgcaaatgatagaccaggagcaatagggtctggtactgtaccccttcccagaggctgaggtaggatcatggagggatgggtgccatattgggccgcgtgttgcgtgtcgaggaagtcgccaaggagttcgtcgagcttttgcatctctgcctttcgatacatggcgatgcggttaccactgcccactatgtcctcgagtatcgcgttggctttatctacccacggcgggtggttctcaagcaacctgatgtccaccgcgcgggccatgagaatgacaatcgtcgacacagaaagagagtccagatccaaggggatgaaggtttctgagtaccagggttagtctcctggccacgaaagacgggaagcaaacataccaagcaagccctgctctcggaggctctcgagaatattcagaatctgctgtgcagactcaacacacatttgtagtggattgcggactttggcggaggccatgagagcgtcagcttccagcggtgcctcgaaccttttaaggaggcagcagtagagcaatggtcgcgtcgcgaggacgatgcactacacacatatattagccctttcgagatggtagttacgttggggattcttatgtacttggtaatattgtagatggagatgggcggcaattcgtgagatgccaacaaagctaacatcggcgtgtaacgggaaggatgactgcaaatcatccgctacagccgcaatgctctccagcacgttcttcgtgctaatcacaaacttcttattgatgcttccgtttgttccataaacagctaaggggatataagcaagttgttatggaaactatcacaagtgattctggttgttacgacgcagttacatacctcgactgacatcagcgatgatacgtgcgaaccgtatgtgcattccgagcgcagcggtccgccgtgatgccccagagtatgacgggagttggcagtgtacgccctcatctcgggttgactgaggaagacccatgagtgaagtcatctgtcgatccaagatgtatacagtccaccagatcttccggcaccgttcgacgagctgctttcccaactcattgacaggcatgtccgtatgcatgccgtgattcatggccgtgctttttgcctgaccaatctatttggaatcgttagagctgaccatattactgctaggttaagtgacatacaaagttatgagccgcgtggcgaaagtccagggcttggtaataccatgccatgcagcataaaatctctgtagatatcacgggctctctgccaagcgcggtggcgtctggcagcaactgcaatgccctgacgaagaaatggacgccaggcgggcgacttcccgcacccttttgctgaacgagactcttcccgaacgcaaggatgaccaagaagtggatataccacaggctagactcattagcacgggcttccgatggaagagaatagaacctgtgcaagttggacatgaactcctcctcatcgaacatgtggaagagttgatcgcagtggaacttgacggcatttatcagatatatggcatggtccacggcggggacaacgaggccttgcaagctctgcgagctcctcgagccatcccaaccgaggtcatacgcacagccgtcaaagagaagggcatcagtaggcaaagcagcttggcaaacatgctcatgtgctacgttcaagacgcgtctagagaagccccagttcgaagaagtgcccagatagactagatttccgtcgttctctggtcagcaactttcattttcccctgcatagaggcacaaactcacaagctgtcccatttgaggccgccatgtattgtgacggcgtatttgtcaacggattggtgaggtccggaggctcagcagtagtatgagtatgcgcaatcgagggatgcctccggggctcctctgaacctcgatctgagggtcgcggagaggattccgattgtgggccgtctcctgaggtccttgcagtaataactgaaaccaatcgccaagttagatttggcacggagatggagctacaggagatatctattactcaccgtcgccatctggaggccgacaggtcacctctgaattctcgttttgcgtgggagcatgccttgccactaatgcctcaaggctttccaaccgtgcaattttatgttgtaaatcagccagatatctacaccgatgacgaggtcagccttgcgtgcctcttaatggtgcaagaagcatggtcatgtcgaagagctggccaaaggagaatatattgaaagagacactgacccttgcgtaaccatgaccttattgtctcgcttgtcaaatgtgcaggtcaatcgacgttgcgcgcaattgtcgcagggctgcagccccgagcacttgatcttctgtctcctgcatcgtgagcatctgtgacgctgtaagccaatgctacgttttggctgccacggcgcaggtaagctgggcaactcaagaatggaatgacttacgcatatgtcgagcgtttggccactcgacgcggcggcgtagtggaagagtccatcttcaagaagagcaaagtgcccgccagccacgcggtttacatccagaatattccacctaggcgtggaccattcgatagctgcactgtccgtggccctgcgagagtcagagatccgggcagctggtaacaggtaacttcggcactattagagcagagtttgtgtgtggctcagtcccagagccgccggacacgcaggaaactcagcgtcataggtggaccacgccccctgccgacttctctatctctatgcctgcccttctttgattgcggaggtgctcgcccagagccaggcatggagatgatacgacgcagcggaagaggacagggctggccctggaagagggggcacgacccactggcggcctggtgacatgagcttcttttcgtggattaacttccagggggacccggagaaacaaagcgacagacgagggatgattggctcgcttctcctgggcaactgataggtaaatcgatacagtcgtgccgtatacgactcgacgccctgccttatcattctgccccttttctatttatctcacgctattccccagcttcagtagatatatggcatactcaggtagagacgagcgacgaaaaagggaggaagaacgaacaaagcgaggtcggctcagccaactgataaggagcggagaccgggaggccttgccgactgatgacaagcacttattggacgcccttttattagtagaccgagatcgctctctgctagctcgctggtggggaaattcctggggtattcccacaccctgaattcggggtgtcgataaattgcctgtttccgtcgcgtcgtattgccatccttctgtctttgcttcagttactttccatttcgggggcctttgagtaaaagcaacgacctgagatccgaaaagagttacagatagatacggcggcaccggtattcagtggcaggagaaatgccagaagatgttgataagcaactagttttccccttctcgattaacattaccgtgtttgctgcatgaatcccggacgtcccattccttccagccccaatcgagcaggcgagggacaacaggcgccaagtgactatcgtgagatgcagctcccacagtgccccagcacaccacttccattgcccagtgaaaatacgcggatttaggcctcgtgatgcttcaaaggtaccggtcccaccgtctgacaatgcaatccctcgcaatagatttgacgagcccgcgtcggataattctcacccacatgccagctaggtaatggctttgagaaggaggagttctaaacagaatagcgaacaaaatagtgtctgggtcacaggaattcgtatcactcacataggctaaatcattcacgtacctaagaaattgatcctccgtccccagccgggctttcccctccatcgctcgttttggaaaagttatacgagcatgataaactgcgcccttctcagcaacttaatatctgcgagtgctgcgatggcaagtcacgatcttacaaccggcgcaaggtgggggcgcataatatcttgtttctgtttctacccaaatcagcgtcgccgaaggcttctattcatcagctcctcgcacatcgcatattttcgctagcgctcggtttcaccagggttccatcaatctcagtcttatgtctcagaacaatgtgctacctcatgatgtggtagatacagtacctgcaagccagtgcgcaagacaatgaggagtgtcaccagcgagttggtggggacttgattgaaagataaaggtaatggtattgccgaaagtcaccaaagggatcaacatcatgccatgatataatggggttatagaattccagagtaaagtgagcatagttgtcgggaagcaagagaagagggcgacgttgctttgatattaggcatccagctaggttgacccccacccccggacgacacacagcggcttgtgcaagagatccaagcatagaaccagattgcctagttcagtcgaggtcgattacttcgcatcaatcggggggcactccggttttctcactcgcctgaacactaaatcgggaagcgcttccggtcgaggtcactagtaaccaaagccaaacgattccccccgcataaagccccgaacgatattgggaagataccttatcatggatacaaaattgtttgggcccatcttgttgtcttgtgcaggggtcgtctcatctcatgcacggcttgtcaatcccggtcgaatccaatgcggatcggatctgaaggcgagcccgttggaaggtcacagccaacagccgtgttcaggtctcgaaactgtattcacgcccaaccttgccacatgaaatgaaagcgtcaaggccaattttctagtgtcctcgtgatcagactttcgttgctaccccgctatcggcatcgggtggctatcaggcctagcagtatcgtgaaactcagaaagggttgataaccatccttattggcaggccactttgaacaaggccgtgttgtttttgcgggctcccagtaccggacctgctcccctagagtcaatcgacgggatctacgggaagagctgcatcacgtagctgattgccgcatgattcaaggaaaataaggccgggctcgacaatggtccgggaggctgacgacgatagacactttacatttccatcaatagataaatagataagaaggttttacaccactctaatcgacccctacccttcccttccatcaccttaaacatcaccaaaacatccatctattgagcccccactaatgcttcacccaaccccaaacatgggcctggccctactctctaggccatttggcattacccgtcaagtccgtgcgggcagttcagttcaccttgtcctgagaagaagctacatgagggcctcggatcccaaaattggaatacggtctagctctacacaagtcactgttgctgatgcgatcgagagcaaaccaatacagcccatagtggcgcccaagagacacccaattccgggcttccccctctcctccctcgataatacatcactactccgctcgctgcttattgcagttgtttcttcaaataagtttctacttcttcctgcccttcatactctctctttcctatcaaaacctacgggtggcttcctcctcgatgtcgacagaaacccactcctacacggaatactcaagaaaaccttctacgatcagttctgtgctggtgaaacggcagagcagacaaaagcttgcgtaaatcacctgaagagtctagggttccgtggtgtaatcctcacatacgccaaagaaacagtctttgatcatgaatcacagagtacacacgcacatggcaagaaaaatgaactagatgtcttcagcaatgccaagggtgtgagactagacccagatattgatgcctggagactgggtacattggaaaccgcagatcagattggtgagggcgatatcttggctgtaaagtctgtttgacctggatccaacccaccttatatgctatcagacgaatgtgaagctgacctgaatgtttctagactgactggtgctggtacggcagtcacttcagcatttgctgcagacgaagccctccctccacagatgatagaggccctagacgagatcgctgcctcgtgtaagagacgcagaatcaggctgatcgtcgacgccgaatcgcaaaaataccaaaaggctattgaccgtgtcaccgtcgacctcatgcgcaaattcaaccgtgacggatacgccgcgatatacaacacctaccaagcctacctcaaggcgactggcgccaacatcaccaaccatctcgcggaagccagcaaggacggattcacgctcgggctgaagctggtcagaggagcgtacatcctctcggacaacagagcgttgatccacgacacgaagcaagacactgacgatgcctacaacaccatctcgcagggcgcgctcaagcagcacatcggggagttcggcgacacccggccgttcccgtcgctcgagctcttcttggcaagtcacaacagagagagcctgctcgctgcactgaggctgcaccaggagcgggtgcgggagaacaagccaaccgtgaacgtctcattcggtcaactccacggcatgtcggacgaggtgagcttctcgcttctgcaggagacgaagcaaggggcggtgggacccggcgtctttaaatgctccacatgggggagcatgagcgagtgtctggcttatctggtgcggagggcggtggagaacagggatgcggttctgcgaactacggaagagtatgccgctctaaagagtgaaacgtggaggaggatcaagacgatctttggtggtgtagcagcctaactacggattaaacaaaaggcatctggattaccgaaccagccgccattattgcaagggtagatgatagcgtcaatgtcattgaattgtagtcaagccagaacagggagccacaacttccacgatagttgatagtgccaatcatgaatcagatgaatgatatcgagcccatgtttgtgcatgggcatggttcgtacgaagaaggatatccctaccataccccagctccatcctcgattacgcggcgaataaagcggacgactaatgatatcaacgcccgctaaatacagcacatgcctttctagtgagaaaaaggaagtcgtcacgcataacgagcattagactattgaggatggcaaagatatcggacccagtcgccgggccggtatcaacactccaccctctccggatcacgcatccggtcggctctgggtgtccgatttcctggatatggggtcggttcttcctgaatgatgagatataactttgaggccacggaatatgaggatcggatatttgataacacattttaattggaatggcgtgatcatatacaacaatgccgtgggccgactctccaaagctcatgttggatataagagcccgactcttttcaagtgtactgtagaactttatccattgcattcttgtttgtgctgaactttcttcgcgagactttgctgagggctggcgaatcgtagctccaaaaaagcagaataataaaaacaataactaagcagcccatcggtagcacggttgatttccatagccccattctgctattattctatcacgatcaaaagtttattcatacattatgaatatcagtacatcataggggcacactcccgtctttcttaaactccaatgatgttattgtctccgtataagtctcttgggtgcacagaactgaattagttcatgaggtcgtgtcttttctcgggttgtcagtacctccgatatccaccctcaggactgctgactgtgttctttctgaccttccgcaacgtgtatcatcaaaccagtagtcatggttcagaacaaactgtcccttctcgtacgtccgtcgagccccaatgttatcaaaatcaaccaccagcacgaccctcgtctttttcccaccaactatctccaacgctttttccttggcatattcaactaggctcactcccagccctgcgcctctagcagtcggagccacatacatcccatacaggccgaaataaaactcgatttcgtcatccattattatcgaaggcgagtctatccacatgtggcttttgaacattgcgaccgcagcctccttgtcgaagggacctgaaagggtgagggaagcaagccattcttctttgaggagcaagtctctttcctggtctttgttcccttcgctctctagggggggtccggcaacagcaactatgttggtcgagagcgggccacatattcgcttgatccaagtctcgtcggggaaagcgatctcccgttcataggatgaaccaaatgactcgggggactgcttcaaagacagcaagcgaaacgctttgtatcgctcgatgattgggtccagtttctctgctggagagaaagtcttcgggagagaataaaccgccattgtgttctcaacgttcttttcttgcttctcgttcgaaagtgtattgaatgaagtttatatgtgctagtgatgctgagagatttgaagtgagtcatcatcccatccccgcttctgatattaggtcagcagtgagagcgcgcgatacgaagcatggcgtgatgctaccttagatcattcattgactcaccttgagtcatatagggagaaaatggggcttagcatttaagttatccatgtcgagcatgatgactctttagattcttgcttatcaattgcgttgatgttagccattctgcaatcgaccagctaaacttcaccttgaatctacgtcgtaagcaagcaaatacggagactcaagcaatgaaacaacaacttatcaggcaaatactaaattagctcatagaacagatctatcaactaccaacctgattgaagcctagagaagatccctaggaagcatggccccaaacgccgtggaaaccgtagcccatcacaatcggcatccttgcccggcccagctctttcatagtcttggaatcaatgacaactaatgaactgcgctttgattccgaatccatagtgactgtcaacaagactccatcatcctcagaggtagggttgggctttgagacgaagattggctctgacggtaaatgctttgtctctggcgcccaaaccatccaccgtctcttttcggtatcaattttaataattgagtccgcaaagttaccggctttctgaacgtgaatcccgtacgagaatcggtagggtttgccatccattgcgggattgattcggggaagctcaatgttggcttctgcatatgggagtgagaactcaattctagccggagtggtttccaacgtgtctttaccgctttgggaagactggcacagtcttggtaaccggtaacgcgtgaaagatccggccaagtcattttttgatgtcgcgtttggtgttccgagattagccctcagatttggaatgcgagcagcactcaagaagctcgtgtcgttcatccggggcaaatcaacaaagatgttccccgccttgtcttcaaatgagttgatctgatgaaacgcaaaaaaggcatcgggagcttcgtatttaccaacgatgcccccatgagtgcggttaataacgtagaagaggacctttcgctccgggtcccaaggcccaatgctatcaacgatgttgtttgcctcttgagtgaaatcagcttgccagatgataagtacaatgtgtttctcggtgccgaaaagagagtgaatataagccgggggtgcatcagtgatgtttgcgaggatttgagtttctcctgaaggggggtggatcccaaaaacacggtaaacgggggggcttgagcttaggtcaagcacatagttgtacaaggatccgtctggagtatggacaggatgggctgctgagtgccctccattaaccaatagagcatgtgaagcctggtaggtgaatatttcaacaggctccaatgtaccagggtcgatttgttgaaggccgttagcatctgtagtactaacaagtgttttgaaaggagcatttccatcagtagaattgccaatgattccaggaaagtttggagcgtaagaaacagcaatgttcatggagctcttgttcccgtgtggagagagtccgtctctgaaagtagtttcgaaggcgccaaaaatcatcttgcaagggtcacttccaaaactcttctccggatagcggcctgtttcacggacaaagtccattatctcgtcagagccgttacggctgcggtatgagaccatctcgttgacaatttcaaatcgatgattgcggctgaagccgtcaaaccagtgctcagctgtgtaattgcccacctcccaggttcctgcgccaccacggtatagtgaaccaatcaaccaatgtggaaagtggccttccgcttccagctgcgttggctcacgcatttcatgggttgcatagaacccccaggtgatagggtctgatcccgggggaggtccaaacgaacctggaaggtcatcttccgcccgagtgagatgagagaaactaagaacgaagggtagaagtcgtcgtagcgttatcatcatgccgagttcaaattctgggcgtgctaattatataccaaaagaaactgtatgataacccaaattatttgaatagaaatatcctacagtcgaaaaatataccagaccttacaaaacgttttatatctgcttggtttcactgccttccatgcttgaggatccacctggtccggagagcatagcctccttgaccaggagtatgattgaaaaccgagtgcgagttcaggtcctcgggatggatttacgtcagctccttcgagttgcgagttgtgagttcgtgccggctctattcacaaacccgttcagaccagctctccacaagagagccacattccgggcttggcaaacatgaaagccgcgttttttggtcaattcctttacgctaggattccggactccgtgggttttgcatcaggaggcccctgcacaaccgcggaggattactggggagccgcgctactacgacaagtcggggagtggtcaagcacaacaacaaattgtgcgcgaatttcaaatgcctcgttgcaattggctattcatcctccaaatgctcatactaggccggtgatcctgatacaaaacggacgagggatgtttctcgcgaccggatgataccactggctacgtaattttcctcagcctagctactgacaatgcgcccaaaaccttttactttataatgcccgtattatgagggttcacaaatcctgcaattgtagctcctttgtatgttttgattagatacggcaggcctctgtatgaacctatttgtaggtagtccatgatctaaccaggccaaggacagtaactctgcaacgaaggaactcttcaaatgactgcttttttttttatgtaaattgattatcaaattcagcttgcttcagtacctccacaataaaagtctccattaagtgtcagatttcatcctaaacctttcatttcacttcatatatagccattcaagcccaagtccagtttcagtaccaatgtcacacaggtgtaactggcggccatctttgatctgccccataatactttgcgtgtagataattttaaacgacataggaaaagaggccaggaatccaagattcgtcacacaatctggtcattcttccgaaggttgtcgtctgaaccattccggactaccgtactttgccatcgtctgcattcgtcgctcgacgtccgtcatttcagttcccagtctcccctcagcacggtgacgttccacccggtcgagaatctcattacagtccttccagattcgttcgcgatttcttagaccattaattcgtcgtcggttcttggttatatcgcaaaagagacggtaccaatccgtcctggaaacggaaaggttggttgctggttgagactggaagatattttcatactcgacttctttttgcttcaggatttctcttatcgctgtgatcgcatcctcgttgctcgaatctggcagtgcctccattttcaagatttggatctttgtctccaggaattctcgctcgtcctgccagtcatcatctattttcctcacatcccgggcctccttggtaacccaaaatgagtatggaagtgtacaccaggcctcataaacccaaggatagttcttttgaagcaggtttcggaataaatactgaggcagagttctgaaagctttagatgcaagtcgaacgttagcaagatcaccgggccccaagtgaactaagagctcaagacggatctcgaatggaagcttagagaagcagtcctttccgactgcggtactgctataatctccaataggaacagcaacctcgtggggatcggagatggctgatccccttgccatcgctttgtccaaatatgattccaaggtggggatgaaacacggattggcggccaaaaattcatcgcctggccagtgatcccagtactgtgaactgcccttccgtactgcctcatctcttggaaacccgtgaagtaccacatcaagggttgcctcgagggaataccagtccgtcaacgcctgaatttggacctccccataccgatgaagacaggctcgcttgaaaatttccaaacaggttggatgaaaaggtatcgctaattccgggaccacctcctcatgaagtaggaagttagcggccagtggtctttcggtgttatgtcgaggagggtacgctgcgggcagttggtcatccacgctgggtaccctatcacaaagcccactcaggaagaaaccgctcgatttctcaaactcatcgtcaatcctctccgctgtgaatgtatttgaaggagactttggtacaagacattgcagcgtggaacatccacgggcttcttcagcagataacaagtagccgttatatgcacctgtgttgcagcagccaggaccgctgacatgctgatagtccatccacagcctatcgtcttccgaggaaacgttgtcatagatgtatctcatatgcttggcccaaaaataggagcgaccgggcatcctggcgggcaaggaatcgagaaaggcagggtagagtaagtcatcggctggtccaggatcagcagcacccattgtgtcggttgtggtctcggacgctccgatggaggcttcttcctcactctcgtttggcgtatcgtactcatacgtctcctcaacagggccggtctcggactgataacaaccatcatcgccgtcatggagccggccactgccccgatcgggatggtcatcatcgtcttgtctgccgtcatccgaaaagtccaattctgcctgccaggtattgatcacttggcatcctccacgtttgcactcgtacttgtgtctgtaatcatgcgtcaccccttccagccacggtcgccaggaaacgccagcgaaaacctcctccttcgtgggatagcggctgacattgaagctcacgccacatatttggcatttcctctccgagtatcccatcgagaaaggtgggcagagacagaaagactcgacttcgactatgaagcgatagaagatgagagggttgggtcattcaagtcaggaggcagtgtgcagctgaggtggaagcctggaacaaagcggggtttcaccagtcaaataagaaaacgtccgcctcactatttcacagctgatgtgaaacatgcaattgtgcaattttaaattaggccaatgacgaatcagagaacttaactcagttggccaacaaacagataatcattatttcccctctcttgcacttgtcgctgttgcagccggcacgcctctctagggtagtcaaaagaagtttgagaatcgcatcgtaggattattagtcattcaatctagtgacaagattcgcgcaattgaacttgaaccttgaaatctctcctactaaacgaaacgtcacggtacgccacctccaaatgatagccgccaatatccgatggcatgagtcctccaagctctgatggcgatgttggcgacacaactgccacagcggccgaagaaagccgaacctcaatgccgaggacacggagggtgcgacgatacggcttcgcctgtttgagttgcaagtctcgcaaggtcaaatgtagcggagaccagccaacctgccggggctgtaggcgctctggggaggtgtgcgcctggccacctcgggcctcgagtctcttatctgccgatgcccgcgctctagatcagacagagtcactaggcagtggaagccgaggagagcagctcaccgaggtggcctcgatcaacactcctgcacagcagaatgccgacgcaagccccaatgggagtagaggtgttggtacagcctcttcttccaccaaccgcgacatggcaacgccgtcgctttggttccaggtgggcgtcggagacgacgggactattatatacaacgggccgaccagtcgctttcatgctggttccctggatgaagggcctgagattctacatgggggtgaaacttcacctcaagtcaatgccctcatgtcccagtataccctcatggactctgtctggctgcctctcatctcgaccaagcaatatctcggagggaccagtgtgcctacagaaactgggctagcactgctcgatatatactggacttggctacatcctctgcacaactgtgtctaccgaccggccttgataatggacctggcacttgggggtcccaattgctccaagttcttgctcatgtgtatttttgggcttgttgctcggcatctccccgaggagcaccctgggtttagtggcgtcggcaagggagaaatttatatatcggaagctaaacagttacttctcgaggaaatggctgccgcaaaaccctcgatcccaaccatccaaggtcttttgatactgggaggacggcagtgcgccatggggaagagttccgagggttggctctacacaggcatggctttgcgcatgatgactgatattggacttcaccttgacacgacgaaacttgcccacttagaacgatggactccctctgagacagagatgaggaagcgcctctataattcagcgtatatttgggataagacgttgagcctcgcgctaggccgcccgccatcccttatacgacggccatacgaagctcatgaaatcttggataagtttgatgatgacaggccatgggcacccattctcacatttcagatccctgaagtatatttaccctgcccgtcgatgaataccagtaccttctgtgccttttgcaggatacacgagatcactgcagatatgatgctcctattctcgaatcttccaatccctgaacggttttctacgcagattaatgatctagataaaaggctacaatcctggtacaatgacctgccacagattctcaagatcacagagccagagaatcttaatcagagtccaccacctcatgtcgtttctatcaagtgagagtcatccccctcgatctccctgaatataggtatttacattctctagtcttctttatcacgcgcttcgaatcctcctccgtcgaccatatctcagctcatcggattcccagcaacgggatcagcatatgaatgactgcatcacctactccgtgcagatcaacgcaatacatggattatacgcaagaacattccctgatcgcctcatgacgtaccaagtcagctactgcatcttcattgctgcgagtatagaggttcaagagctccaaactgcgccgacatcagaaaggcgtgacgctgctgccaaaagactcacggcagccgttaaagttctccaagacgaggctgcgcatactcctggcgtcggccggagcctcgacaccattcggcggctgttacgcgcagaccagcataaagccctgaggaaaaacggtgaaaatgaacacaccatctcttctacgcctacgagaagaactcagccagctcgaatactgagcaacgctggaaatgtgcagccggtcagtcctagagctcctgatctagctttggttcgtgaagtggcggatccttaccccatgtttgcttcgacaaacttgttcggtgagtttgacgatgttgggtcagcgtggactgacactggagctggtttccatcctgaagtcatatcttggtctggcacagatagtttgcaaaggccgtccaacatgtcttcattcggtgatcaagcttggggtagtttttgactaataaatgtattatttcactgagggatatcgcacctaagacaaaaagtatatgtgtaactattaatcgaaaagaaaataggcttaaatcaaatggagtaattatgttttttaatgtgaaaagatcctaatagcctttctcttggatatttattaaggcagagactacttaaagcgatcaaacatatcacgactagcagtattgacacgaggcttttcccaacattttctttttatgtaactctccttttgttcttcaaaaagaagactttagaaggagaagtaaaagttctacggcggcctaggagtccaaagacaacattaatatagatcaaggcacataacggtacatggggtgcgcatcaccaatatcagcaatgtcctccgggacatggtcgatatcgctcttcccatgcttgctgtcgcgctgcttattctgccagcgtaagctcaggctgagaaccaaggcaaccagtgcggcgaataacaacacaccgcaacatatccacatccctttctcgtagtacggaccttcggtcttagggaacagccgggcgcccaggataggaccgcactggccgaccataccgaagatggcaaggccggcaccacgcttagacgcggatccctggttgtccgtgacccaagtgaatgtcagtgcaacggcgggaaagactccagcacagacaaggaaggtagcgaagtagcggacgccagtggtctcgactgtggcgaggatgacatagccggctgctccagcacagctgaacaggacgacgaagatacctcgggtgcggacgcggtcggagatgaagctagtgaggatgcaaatgaagaaggcagaaagataagggcaggcggatagaccctgggcacgcagcgacgtgaagcccatggaagtcaggatggtgggtaggtaggcaggtagagagccgaacgcagtgtttaggcaaaagatgatgatggcttggaggtagttcttgtagtcgtagaaggcggcgaatacttggctgaagttgagctttccctgctgatcttgtccacggcccttgatggctcgtgcggcaatgatagcattctgacgctcatcaagatatacgcattggcttggtgaagctggaaggtagaagtaggcggccacagcgaggaagagtgttgggatcccctctattcatcaacaccctggtcagctaatccgccctcaagttagggtttatccggtttacataccaacgatgaatagaagttgccattcagcgatactagtcttagcatgcacgattccataggccagagcagaggcaaagcagtttgccaggggtgagaatgagatgaagagtccatatctcagacccatctcccgacggtgataaaagaaggtcatgtaaagggcaacggcaggtacaaaacccgcctcaaaggccccgatgaggaatcttgtggtcatgaggccgccgaaactggtggcacctgcttggatcatgcttatcacgccccatccaaatgccatgcatgcagtccacaatctaatagggacaaacttccatacaaggataagctaaagaggttatcagaatcatgttaatgaatgctccataatctcagtatatccatcattttgtgaggattacttacccaatggaagacaatgtagccgatataatagctagtgacaagccaggagtattgatcggaggtaatgccccattccgaacccattccggcagtgtatgcattcccaatgtttcctcggtcaatgtatgacaccatgtaaaggagaccaagtctatgtattggttaattcgtcccttgctgatatctgttctgtgaagcctagctcatgggtgtcttacaaggggatcaaacaccagtccagtttccggacagccttggcttcctcttcaggggtccaagtagtcaaaccagattgaccctgcttcatgctgttcttttcggcatcacccactccaaaggagggggcattgtcctcgacatgcgaagtctggtcgggcgacatcttgctggtctgatctgaaacctgctgatcaacgttggcgttggtcatcgttaaactggataaaaaacctcctctgagagaacactaaattcgttgagctttggatgatgatggtcgaacaatgcctcataatcggtggacattgcttctctttaagcaacccatctcgattcccagtgttgttgctgaagtcaaaagttgcggggtgccccgcttgattggaccttttcacccgtggggaatactaaattggctacaatttcggcatgtcccgtggggaaggcggtggcaagttcggtattctgattcgtgaagatgtcgcaatcttcggcatctttggcacacaatccgagctcacctaatggcgagccatgatgggtggagggaatgccgaagggtaccagctggactttccgagtgacagtgaagcacaaggaggtcagacctgctgatcttgccacaaattacacccatgctacacaaataccgaggcacactgagggtattgattggagccgagatcgctctcgagttacttgggctaaccccaggacgatgattttgtacctcacatatattactagaccctggcagccaaaccatctacccagtaggacgtaaacagatccaggtgcaaatttggtgctctcattagcaaaatggacgaccctagcaatatacaggacttttccatcttgactccaaatgccatgctgggctatggatacaattcggagcacttctggtatggaatcgccaaacataaaccagcggccatcattgtcgacagtggctcgactgatgggggtccatacaagctgggcatgggtaaaatgacatgcggccgtggatcctatgtgagagacctcgaaccaattctttctgcctgtttccaccacagaatcaaggtcttgattggatctgtcggcggagatggaagcaacaagcatgttcaagagatgctggacattatttctgaaatctgtgagaaaaacggctattctttcaagattgctaccatcaaggctggattcagcaaagatcttatcaaatcaaggatagaaaagggtcgagtcgggccatgtggtccagttgaacctcttgatgccgacacagtggatggagctgtggatattgtcgcccagatgggagccgagccgtaagcgttcccggaaaccttttgtccttaagtttcagactaactcgcctctacagtttcttggaagcgctgaaaagcgaccctgatatcatcctaggaggtcgttgctatgatcccgcgccctttgctgccttttccatctcccgcggagttcttcctgatgtggcttggcacatgggtaaaatcatggagtgtggcggcatctgcgctgttcccaagggccggtctatgatcgctactatgagaaaagactcattcgacctgacccctttatctcccgaggagcggtgtacgcccctctccgtcgccgcccacactctctatgaaaagacacgaccagaccgcctcccaggccccgggggtatcttaagccttgaaaatgccaagtatcagcagataaccgaaaagacttgccgagtatcaggagccaagttcgtccaaacgccgtaccaggtgaagctcgagggcgtcacacaccttggctaccgtacgatctttattgggggcattagagaccccatcctaatcagccagattgatgatttcttagagagggtccgcaaatactcgcaaaacttgttcccagagcttgacaagtccgagaaatgccgcctcatctaccatgtttacgggaagaacggtgttatgggcccgctggaaccccttcagtctgctccccacgagattgccgttctcggagaagttgttgcacccacctctgaactttcgcacaccatcgcaaataatgtgagggcgtctattcttcacttcgcctacccaggccaaatggctacaactgggaactttgcaagccctctctcccctcacgagcaagatgcgggcgccgtcttcaaattcagcctataccaccttgttgatctcgaggagggcgaagaggcatcattgtttcctatctctattcagtctatcggcaagcaggattccgccgtcacgcccccaattgctctttcggaggcgaaattgaaagagatcgataatggagctcttgcccccatctccaccaaggtcgttcctgacggcgatgccaagctaagcgagctcgcacgtatcattcgttcgaagaactcgggtccttttgagatgacgttcgatgtcatgttcgaccagccggcggtttaccaaagagtcaaggccgccaatgtactgaccaacgagaccatcaagaccctgtatcaagtgcgtgacgaagatattctcacgaacatgtacttcgacccagccctagcatggaaatgtacactccgacggccgtgggctcagggaagtgtgggcgagcgtgatacgcttggtactcagcagcacgcccctctgctagatgtattcgtcccaaaagctgctgttgtcgaccgatccacctttggagcccaagatgttctgaaagatctctgggttgggctcggtcttccctctagcgctctcgattctgtttctttgtcggggagtgatgctctggttatcccatcgtcatacaaattgggcattcttgctcaaagtgcgatcgccttgaccgcacttggagcagcccaaatatactctctgcgcagtaacaagcctgttcccagaatccaagtacctttagagcacgccgctgtcgagttcaaatcagagagattgtacattctagacggcaaaccggccccctcaccatggggtcctattggagggctgcatcagacgtctgatggctacgttcgagtccacgactcgtttcccaaccatgcgaatggaatccttgagctgatgggacttcctttagactcatccagggaacgtctcgccgagaaaattaccgagtgggccagtatcgacctggagcatgtagcaaccgtggaaggcaagctcacgacctatgctctgcggtcatatcggcaatgggattcattacctcaatcaaaggcaatcgcaagcttccctatacaagtcacacagatttcatctgctgaaccaaaacccttccctgaactggcgcaattgagtggtggtgcgaaatgcctgcgtgggctgcgagttctggaaatgagtcgagtcattgctgcccctttatctgggaagacattggcagctcatggagccgatgtcatctgggtaacgtcgcctcggcttcctgacctgccgactatggatcgagattttggccgaggcaagcgtaccgtccaactcgatataaacaacgcggccgacaaggaacagctgataaaactgatcaagacgtgcgatgtgttcatccagggatttcgacctggaagcttggctgccaaggggctttcacccgaggaattggtcaagcttaatccaagtataataattgccaatatgtcagcgttcggacctgatggcccgtggtctggtcgacgaggctatgactcgcttgtgcagacttgttctggtatgaacatttccgaggccgagcatgcaggccaaggcgaaattgcgcgcccaacaccctgccaagccctcgaccacgctggaggttattaccttgcctctggaataatgacagccttgtatcgaagggccacccaaggcggctcttggagagtagatgtatcgttggctggtgccatgaaatatctccgcagcttggggcaatatcctgggtcaacagggttccagtgcaaagacttggaaaagccgtcagatgttcccgcagaatatatagaaaagaggccaaccgggttcggtatgatggaggccatccgtcacagtgcctcggttgaaggttgtgaagttggctgggaggtcatgcccaagcctctgggttccgacacgccccaatggctgtgatttgtacaattaatcaattcaatatgaagttagtgtagttatatgctgaatggaaattttcaccaatacacaagtgtctcttttcatacccaagtacaaatagaatatccgaggcgtatgggcgaccccttcaccaccgttgaatagatgaaatacctttgcatgattctggattatcatggtcacccatcttacctttcaagtgcaaacgactggctatgtgatcttagttctaaatttaattttaacatctcgaaaagtctacatcagttatgctaaaggggtttacataaccgatccagctgaactcagacagtatcttctcaatcggatttgtctactaatttcaacaaagggccaaattgcctacaatagaatagcaatatccggccggttcccccacttgcctaaacgcttcggtatcttgttcggcttttgtttcggcatgttcgcccatccttccacgcaatcccagatgacacttttcctcggtagtgaaaattaaaataaaaatctcggtacggtaggtagtgctagaatgattagcctatttttcttgcggcggatgaatgggcacactgtgattggtgcatttttcagaatctcctcggttttggctggctcgtatttccaaccaggcgtacatcgacactgcgagacatacacatgagtcattttcactactgtagcattcttgaatcagtgtgcgtcggaggtagcctagaagatagcgaccgcgccgggaggacttgcaatgcctcctggaatattcaatggtacactgaccaacatgaacgtccacctcccttccttctggcatttagcagccaacttctccaagtcaaaactctctccaattggcatcccccatccgcttaagaatacttcgtgcatagagacaccatatggctttgtactcggccatgcttcatacgcgacagtatcactagccaccgctgcaaatgctctgtcccaatgccatcgaatcgcagcttcgctggcctggatcccgcaagacgcacgtatcgctctgctggacaatgcgacctgagcggcaggtgacagagcacggtatgctggaatccaaccggtgcgaatgaggaggatatcgcccggaaggaactcaaccttctgttcctttaccacttccagaacttgctctaagggaatctcgtgcctagagaaatgatcgatctcgatttcttgtttctgtgcccatgagaaccaatcgagcaagacgccacgaccagtgatcgtcttttctgcaagatctaccacaaggctcattgattaatagatgataagggaggtttcagatgaagcttagacgcactttgaataccggctttgtagtttagctcttctcccgaaatatcttcttgcgttaccccattgtagtacttcaagctctcttggtaagggtaatgtctgaggccgtcccaatgactagatccttgggtattgatgtcgagctagaattttcagatttgaccattttgaaaacctggattggaataactggtacgaacctcgtcatcgttggcatgtcccttcacgataatgtggtgagaacaaggcttgcgtagcggattcatcggttgaatgaattcatccaggggcagactgatacgactcgttagataaagcgcatcttacaacatcatatacatttcaagctactcatacttgagggggatagtctctccactggcaacctcttttgcagctctcctgataacatctggagtcagcaggttgagagtacctagttcgtcctggtctccccataagccccaggcagaggccggggggtccgtaggtgctagtggtagttcgctgaattcagggcgaggcttttctaaagatttgatgggagccatgattatgatgacgggagatggcagtgacctgttccagggttccacaagtaacagttgggatggggcgaaattctctgtctgttgcacgtctagcaaggaacagttccattatttaattaagtactgcaacttcacttcgtatacaagctattctaccttcggtgtgagcatgaatagtcatccctgttggtgggcggctgacggagttcgctccatcggcatttcggtatcttcgttttaaccttcggattgtgttgagatgcgagttttccagcccagattcgttttagcgcactgctagctcagtctaccttcagagaagctacccgcttagcctggtgactatccacagcgatgctactgaccgacagctctgctcgcccggcgactacgacagccatcaaaatgtacctaacttatggagatcgagagaatattcaataaccactcgtttctcctaacgccacgcatcaaaccctatgtctagaaagcgatcacggacattgtggttattttattcatcgattcaatagacatccagccataaatcttagttatcatagccttggccttgtcgctgaaattgtaggtccgccctcccatcgccatcttcgccgtaaaatcagtcccattttcgaaaacgatcttcttaatcatgaagccccttgacacaagattctctaacttgtccttcacctcagcttggggaagtgtcggaaaggttgcagaactgccgtttttgtccttgagagccccggcctcagcatcccaggccagctcccactgatatgagggattgccgtaggcccaggggttgctaagttccttggtctttcgggaggcatgctgggggagaaaagggagaatattatcgatgtaggtggtttgcacaaagtccgcggtaaagaagaggcccatgtgggtgttgttggtgtcaatggcggagacctcggcggttggcttctcaaggaatttgaaaccggggtcggcgaatagagcacggaggagggcagcgtaatcaaccgccagctcgtacacctaagccggggtgaggtgttgagaggggtccaagtctgtgaggcatgatgacagcgctgcagaaggtgaatgaaagacgtggcgagactttggtcgatttcaagatgagtcgcaacttgtgctagccaggagaggaagagccagctgttccaattgccttcgctggtcgtgatgatgcgatctcaaaagaacgtctggccaatctgcagcgaacctatcaaaaagtctagcctgtgtcgcgacgcgccgcgtgagattcgcgtcaagtttgcgaaaacacctaccctacatagagaaatagctggcatgcagtcacttgcaccataccattaggaaatgattataaggtatcttcaatcagtcgatatgttggactagtcgagtaattaaattgaaaaaaaaaaaaggcgcattaatggaacacggacgtgtattcatcagagtgataggttttacggatgcagattagagaacctgctggcttagacacttcccgtaccataaaatgaacattaagctatctaggaatctatatcggaggaggctgaaagccaaatcctgacgtctaatattatataaacagaggctcaacaaaagaaaaggtattgtcgtcacttggagacaaatgaaccagcaaaagtttggacgaacagggaatcgaaccctggaccactcccaaacatcttcagtagaagaaaacatgctaagggagtattataccactaaaccattcgcccaggaagtgagtgaccactaagggtgctgctggacggggggtcgatattgttaataatggattcattcagcttcaattggtgcatgcagctgaagccattcgtccaaatcggtatcttcgtatctgcaccagccgaagcagacaagtctgcctcttttgcgcaactttttgtctcgagccgacaatcattatggcaggaatcttgattattctccttgtgacagcaaggaccaaattattgctcagtacataggaagttcggttctttcggtcaattgaaatatcatgctatcgaaacagatcacgcgtgggaccaagacaaatctgccttaccaatagtgcatgccagctgagccacggccgaaaagtgccgtccgtcactcactactggctcttcccaaagcccctctttgtctgaagcccgccacgcctccgtgaaaccgacataggtcatcagaagtcctcattccaagcccgccagcgagctcaagatctagacccaagccttgcatgatctcaggttggacgcccggcggcctctatgcctacccctctctagttctaccgcgatggatggccgggctgcagggagagggattgatggcgttgcgcgtcacgctcaaggggcaagcaggccatctgcaactgcaacgagaggaggccgtccaagcagccaaagaccattctccaacccgttaaaggacgtcgcgaatcagtttggggataggcgaaggccagtctctcttgcgtcaggtcgccgggtgattgctactgcccgtgccaaatttgcgtatcaagtcgtttattcgacggattgcacctttgagaaaggagacaccatcaatgtctttgaaataaaagaccacaactggtggtttggtgagaatgtacggacgggccggattgggcagttcccttgcaactacgtgacaataataaaaggcagcaccggtatgggcgttctggctaggcttcgccctatacacgatttcaaagctcaggaaaaaggtgacctggacttactggcgggccagacggtcctagtcactgaactgatggaagacgactggtggaaagggagagtcgaggactccaacggccccgagggtgtgtttccccggagctatggtgtagtcatccgagcatccaccccgaaatctggccaatagttctggaagggcctcaaggatgaattcgaggcgtacagccaagttgactataatggtgatctccatctgggcttgtcgttcaaggttggggacaaaatgctcgtctacgtccggcttagcagtttgctttcatggggcgtgaacctggaatcaaattttcaaggagtcttcaaccatacatacgttcagccctacggcaatcctgatagcgcaggcatcatccgcgctaatgctatagccagctacgacggcaccgtctgtgcaaacttggctttcgcgaggggcgatatacttgtggtcaaacatatcttggattatgaagtgtcatgggcaagaaacagcaggacaggcttggaaggtctttgcccggaggctctcattgggcccgccgtcccggcaggcaagaatgactcgaaaccccccactgttccattgtattcaccgaacaatgtgactgcattatacacgtggcctggagagtcaatagaggatatgcaaattgtcaaaaatgaccagatcttggtcattcaaaccttgggtgatgattggttaaagggcgtcaattggcgcactggcaagacaggcgtatttcccagaacgtatgttcgcttccaagagatcacaaactctcaaggtgagcaaaagtcctcggggaatgtcgacatgttagctgcctctcaacctcaaccggccgctgcgatttctccgacgcaacatactcagataccaccctctctcccacatgtcaaaccagtatcccaaagccggcctgtaaggcaacctgaaccgatgccagcagctgcaactcctccaacggagagcactcaaatcccggttttacaactacctaccagacctgtatcggcaagtagattggacactgacctggtccgtgactcgaagctcgatacgtcgttcactggtgaggatgtagtctgccatacctcctatacattccaccctaggaaccgcaacaaccgtattgtcgtggaagagaaatggaaggtggaaagatacctcgggcgcggtggctttggtcaagtcgatctacagaagtgcgtgcaaggaccgaaggagagcgaactgcgtgctgtcaagaagatcatcaaggacccatatgatgatgaaaccaagaaaatcaattatgaccgggagctggaggcaattgctaaattttctcatgagaaggcaagtgatattcaattcctattctggcatttagagactgactggttgtgttctttgcagtacgtccactgttttgcacgctcatttggctggtacgagaatgagaatgccatcttcataaccatggagtattttgaaaatggagacttgcaaaaacacatgcgaggccgcttcccagagtttgaggttggacaaatcgcctctcaaatcttggagggcctcagttatatgcatgacaacggatttgctcacagggatttgaagccagctgtaagtttgctaacccagaaaccgatcaactaagatacccgatttgacgcgcatcttagaatatcctcgtcaaagaacggtcgccgaattggtgggtcaaaatcagcgattttggaatctccaagcgtgccagcggtgaccacacagcgctacacacccttgttgggacaccacgataccttgcacccgaggtgatgaggatcttttcaccagaggacactgaagatctggacagcgacaccatggcttacactgtagcaatcgaccagtgggcgctaggggccatcgcctttcaactcctcgccggcagagatccgttcccgcaaccacgctctcttcagacctacgtacatggcaaggagccattcccttctagtgttttggcagctttgagaataagcgagccatgcatagaatttctgaaggccctgcttgcaccaataccttctcgtagactaaatgcaaactcagctttgaaacatccatggctagaagagatcagccaatccccccagcttgtggaccaaaggtatgtgaagaattctggatattaattggtattattgagaggctgaccttcaaaagtgttacattaatcgaagaagaattttctcttattcaatttgatacagaaactgcaagtatatcgtggaccgaggcgcttcaaaaaccttgagtttgatatctttcgtctctggcatcggttgttcgaagctctgagtcggctctttgaaatggaactggttatctatatatgctagatggagagtttttggtcttcagtaaacatttcgcggcaatgttagaattagagatttatggcgacgggatgaatggctgagagttggcttgcgtgtattgtaatagttatcatgtagggttttgagaatattctgatgtagtaagcaggttttggatatcaccatgcccagttcccatagcggtggtcaatgccgtccaaccccctctatccttagcgttgatatttgctcctttcttcagaagaagtttaacaacgtgtttgtgcccagttgacgtagcaatcaatagcggggtacggccatatatatcagtggaatcgatatctgctccgttctcaagtaggatttcaatgatcttctcgctgcccgatttggccgcccacgatatcggcgttcgtttgaatttggtatcctttgcttcgacctcggagccgtgttcaagaagcatcttgataatagggcgattgttcaaagaggcggcaaccatgagatccgtcagacccccgggagggttccccccatgttcatgcacccagaatgtcctgagccagagcgagtagctttgcgactttctttcaaagatatttaaggtaagtgggatgagagggttgccatctatgatggaggcattgcggaagtgaaagacccaattcgcaacagcgtaatatgaaaagaccgttctattggaggagccgctaacatgtgccgcactctctccttcgcaactcgactcgcaaccatcaaccctggtagcctctttagtatcgttcgagttaatcaagttgaggtgaagcacgcaagcctctgcaataatagcatgcgccgctttcattgtgaacgagtggtgccatcgctgtagggacagagtagtggtcctattatgtatcgtaggctctgcaaccagaaactcgcgagccgtttgatgaagtaaatacactctctcatgatggacggagatgaatagcccacaccaagaccgtagatgcatcttgaatacgtcatttgattccaaatcgagatcatttattgaacgcgtgttgtagtccacactaatcgcatcgttcatatctgaaatagtcaacggctgcctggaagccaacacgatgcccaagactttgcgaactatggtatcttctttggttctgctaagtatctgttcgtatgcctcgttgacgctggtaggaagcttttctatagctgcttcacaaccctttatggtctgtttgaagtccgtcttgtccaggtagttgaagacaagatatacccataggtaagtgcgatggactggctcgcgcaatttcttctctaaatgattcttgacttgggttgggagctgcttcctctgggatagacggttaattcgaaaagttataacccgattcacttcttggctgataatttctgactcttcctctccaggaatatgaatgttgggaaaccgtttgagtagaccatagaaactggacactatctgactgtatgggcggcaagtgaggaaatacttcagcctctcaggatgaaaggggctctggaattggctttccagatttcgcatcaagtcttcgaacccggcttcgacgcactcatccagggcatcaagtacgatagtcacagtcttctctttggtattcagcgtcgcacttttcaagatcgcccacagagaagaagtagagttgattagctttggcccgttcttacggtattctttcattgcgtgcttgattagaagcggcatctgagagaagagctgatggaggattgcacatagagcctgacggacagtgtcctggtcttgggacttgaagaagaagtaacagatgacatctgatcgtggtagccagtggtcgatgaggaacttggccaatgtcgacttcccacagcctggatctgcggtgactaacagcggaccagacgccttctccatccaggcagagaagctaggatgctcgagcaaccacatgcatgtgccttcgattctttcttcaactcgatctttataccattcgtatgtgacatccttgccagtggtagcaaggcggaataattggtggcactcctcctcgagtctctccgtctcggtttcgcgccgaagatgaaaacgtgtcactgctgcgtcatgggcttgtttcgcaacgcctaaatgctcctctgcgatattcttctgctgttgtgccactccacgaagacctgtgcatcgggttaatataagcaagaccttggtgtcgtctgcgcttcaatcttaccagaaaggctatcacccaacttttcttcaatctcaattttattagggggtattcgacagagaagatctttcgcatatgccgccgctaccatagctgcatatccctgccactctttattcttgtgagagtctgagtagtcacatatgccgcgaatagctagacagggaaagtgattcgccaacccggccgcctccatctcgaagcaaaggatccccctttctgatgcaagcctgtcacgctctttcgcattcttcatcagctgattccctgaagcgattaaaccgtagtgaaccaccgggttatcctcgtgctcggcacgatcggctcggaccacaaggtctgatggactgcagacggtggcacaaccttgttcgtttgggtggacgacatcagctcgatataaccgatcatgatttgatcttggtcgcatatacagacttcctagcctcttgtttctctcaagcacactatttattgccacttcaagtccatggccctttctctcgtaatgactttgaaggccggccaacgctgttcgtaataaaaatggtggctggtttaggagccctgtagtttgaaaaccttctccctggagattcttcccaaagtcatactgaatcaatccacctttgccatcagaagaagcgccgacaacaatgtcacccaggcggatgtcgtgacttgggctgggggcgccgccaccaacgccaaccatcaggccaatccggacattagggaatgaatgcatcatatccctggcaacagcagccgcagagtttgtcccatactctccaaaggggagcgtggctatcacgacattgtgtctgccaattctacccagagcatagttgttgttgtcgtgctgggagaggtattccgggggatcgtgctcttcgtcgagaaattcttgcgccgcgacgtattccactttgatggcgcagatccaccccaccgagtatttcttggggtcggacatgttgtggagaggtaataagccaagaatacttatgatacagggggtggaagagtcaaccaagacgcaggcagacgccgtccaagatctcgagaagacccccgtttctggatccgtggaaatggttcgcctgccttgggcggggtttgtgcacaatcatttaccgagtgctcattgaggcgaaccagccaatgatgtatggctaaagcgcgcaggttgtggtcctccttcaccaatcacaggatgatacgagggctctctgtcagcagttccggtacttagctcagctgactggacaattcgctggcccttggccctgattgtatgccaacgtgtaaggtcaagattccggccgaatctggtgaaggcgcgccagatgaaaagcggcaggatgaacaggctcgaaccgaagcagagaagaagaacgatataaatatccacgtcttgtattttttcgggtgttgcttgctcttaccattacgggattctcccactccaaagtcgctaccattcgcatagccaccgattcattcattgtggctgaatccacggcgattctcagtcaattacgctccaagtgcttgggatcggggtcagacttggggtcatcagcgttgagaagctcacaattgagagaatcaagctctagctatcgaataaaacctccagtctgataccaagctcatgcatgccttgattgcactggaacgattgacatgcgcctgccatgatattgaagttgcgatcaattttcgctctggaaaatatgcagatatcagaccattcgagtatcaaggtgacaatatctcactgagctattgagtgacctgattctcattgtgcattgcgtgtcctccacctcgtttgccgagtttgtggcacatgattggtacctcaagaggcattaaataacccaacagatttgatttgcttaggcctacgtgtgtagcctcagtcacgatttgcatgccgaaaggtgaaggtacatacatagtcagatcctatgagatcgccgaccaagaccaaattgagaccacccctaagatatatgcgcaaggagcaaggagcagattgaacggtcaagatactaaagcagaagaataattaagtgaaattagagagtgtatataacaaagaagacttattatgacgtttaagatgccactccaatgatccggtgcttagttttgtataaaatgctattgttcttccaatgccgtgtccggcacattgcttgatctcctttcaagttgacccccccgtcgaactaatagtacgttgaccgacggatttatcgctacttctgctcctgctgttgtaattctgtgcccacatctcgggacccaagtgattcattgtctaatgggagctgtcgttcttccttgggaagacggaatcccaagtgcttcaagtagctgcctgggaaccatatgttgtatatgacacatacgatgaagataggaagtgtgtcgaagacatattgactatggagccgtcgttagtctgttgacttatctttagcgttactttaggggatgacatactaccactctgcctgttgtgttgttcctgatttcccttgggcgaattcaatcatgcgaaaaatagaccgaatctaccagcgttagctttctctcgccttcccatgaaaagagaataaaggcgataacatactagaatcaggagacaggaggcattgacgacataaagcaacgtcgagtagtgtttggtcatattccacctcgtctcattcttgctcgcgtagtcgttgctcaactgcctcgaggtgaaatggaagcgtaccgcagccacggagaacagaccaaagccaaagagctggaccgaaacaccagcgaggccaaggttcttgcccagattgactttatccttcgcattcgagtcagtcgggtcggtgccggcgatgaggacagcagcacatagctgcaggaggagcgagataatatcgaatccaacgaagatgagagtgatgaatcgagctagaaaaggaaatgtcagaaaatacggcccaaagacttccttttaccctaatcatcattatggcgtagaatactgacgaggaacccaaatcatccgcatcgtccgatgctctggcggcacagcccagaatacaatccgggaaaacaccacatagatgacaccagccatcagtaccggggcgagaattactagcgcgaactgaacaacgtagggagtcttctcctgaacattatttgctgagaccacacgggttgcaaacccaatcacctccactgaagcgacagtcattagcaaatgctggggagggatacgatatcgaggaggggaatttgggaatttgagaagtcgacttacttgcgatagctaggagcataatgagccatacccatgacctcttgcgaataatctggaccagggtgacgaggaagctgaccccatacaagccggcaacaacgccagcaagtaccgccgaaggggtgtagagatagtgtgaaggttgtgaggtagccatcgaagcgatagtgatatgcttaaaaaggtgaggaaaggaaataccgggaagaacctggattttctcttatttaggcttcgcagtgtctttttccatacagcacaaggagctgagggcatcctttatattcatcattctcattcgagatatcggcggcccctggcaccgatgcaatacaacctgatgggcaggggacccgctcgaccctgctgagagatagctagcgcaaagctacgtgccagataacaggctaactgaagcaaggagggatcgagactgcggctgagcacagattgctggtgtggtgtcggtgaaacggcgattaggtccgccggctgccgattgaaatctatctgattggtgcgtcgcggcccacttttgctgcgacaatgtcggaccacgcagctaaacttcgccgatgctccggttggtatgacatggcagctcagcaatgccaggagagttctaatcttggaaatgggaaattggatcaaaattggatgctaagcatgggtatcggcagctgctggaccgttaggggacttggctaggcgtggagatgccaagtaacctttaaacatgttcgagctggaaatcctagtgtataagcattttcttgatagctacatagtcatgatttgtccaagctcttcatggtataccccacactttgattattgacggtagtctagggatagtgagttgccgcgtcggacggccagactggggcgcaacgctcgcttgtccgccgactagcacaaaggtaattctccgctaacgcatggaataagccatggagatctaagccaccatatccattctccagctgggaaagccatcgggcgttaaggttaaggtggattgttggttgtccaacagcttcgatgagattacggcgcctaatttcaggactgtttcgatttcaggaaggaccgggtgaatagaggccgagtaccgtcgttggcgacgtcgaggcaaggtgacttggttatttaggttgagtaaaatgagatacggatatcaagatggaggctcaacggaggacacgactaatccttggccgttcaagggacgtgtgctaagattggacttagtggtctttttataaggaccttatttctgtgatcaagaaatttcgacgggggatcttgcatttaatggatggtcgctgggtcttacgaactgcatcgccgcgctgagctctaagttaccatgtcgttatgcacagcttcattgtctcgagccatccaaaagatgtctttgaaacgttcagacataccactggagcctgctctatagcttctacctggtcatttctggcttacaattatcgtcgatatttcgctgcagtaacccgacagccttaaccacatcaagtacaagtcaccagcccacatggtacacataaggagaaactacttccctaaagagccaagaaatcaattcagcttcagacattacaggaagaaaggggtgggttttgtgggcttagtcttattgggtccaatagttcatgcgatctatcggcagccatggttgatgcaacacccaccaatcgatctttcctggagaccgttaagaagcacacctgatactgagaaaaattgatgctttagcttctgattctgtcctcagacgaaattgcacgatcccggatgccgaagccactgagatatagagtcaatgcaaccgcagttgtctcgccgaacttaccagactgatcaacactgcagggataagagagaattcctatggtattaccaagagacatggtagatatctaggcaggatttggagagcatctagaggcattgtgatcttcgccctcttgcctgtcacactatacagcgcgcagattgccttggaggctagcagataatggcctcttttggaggcgccttcagttttgacatatccgcgtttttggtataattcaccatgagaaagcagatgaactcgatagtaaataatgagatcatttgggtctaaatgtttgaaaggccgcacctagatgtcatgtggactagcctggccatgccaatttagcacggagcacgcactagctcagagttggacagagggcaccacaccgattgtctgggtttcctgaaggagtattgatctcaaaggggcttaaaagcagtagaaacaaaatgtaaagtatttgagtttcattgatatgatgagattagatgagcgcagcaatataaatttctaaggatctgtagtgttcagtatagccagatcagtcttgtttacattgatatgcaaaattgagagagaaactgccctttctaccataaaaacattagaaagaatttgcagaaaataatatcttcctagcttggctagcttcaaagcagactctaacatgtgagggaagaggccgagatgtggcgggtaaccgacaactcgccaagatgcgctattgttttttctgcacaagctccagcctcagctgatgatctcccggctagacattccccccaccgggccactgggttcgattgggcacacgcagggcgactctaggccctaatctattgcggttgtggtggtttgggtggcccatttgccgtggacgatgaacttggcggccgcttctcgctggtttcctcctcttcatcttgctgctcctgcgaggcttttcgttgtttcattctcggaatgatgcatttgaaaagaacaacgagaaagacgattaggacgacgacaccaatgacaaggccaataatagccggtttagataggtggatatagacaacgttcttgttcttcttttccttggtgattttgatcttcttgaatgttttctcttttcttacggtcagagatacgcgttcatcgtgcccagaaagaatcggcaatgcggtagcataggcaagcggtatcgccgatgcgaggagagccagccgaagagctatctcggtgcccagtgtcgtgatcatttggctgtgagttcgtgccgcacctgtcttaccgaaaacaatgacagagaaagatcgcaggagaaagagttgctgatggaatcgatcaattgagaaccatcaccctttatacttatgggggtttggcctgaatgtcacaagcgcgcgaagctatcatcgctagtagcgccacgacggcgaaatcattatgtgagctgaactttagtgctttgctttggttaagcttaaccagtctagacccgtccccctgtcaattgcgagcagatgaccacagaccaggctgattgagccctgatggttctcgattggagatatgcattggcttgactggtgcgacggagcaagtaagcagacactgaaaagcatccacaccagatatgttctggatgaccttgccatgtacactggtcgctgttgcagctattgtttgccatacttgggaggtatttaaatttagacccctcctacctgactacaagtgatgggaaaagtttggcgttaatgaagcgtgaaatccaagagccagctgcttagcggccttccactgggtttctaatgataacttagagagaccttctagtagaattggctgatagcttgtgaaccaatccagctggactaaggcagcaatttcgcgaagagatgagtagcatttgggtccgccgaatttaaccattcttctaaggtagattttgtgtctatctgtatctcgttgggttccttgtcgcattcgtgattcacatgcagctatggttgtaatccccttcgtttaaaaatgtaactagcattacgattcatccaccttctcagggtgctcctaattttttacaggcgtgacaaaacctttctcgtcgaagcgttgtctggtagtgcggcaaccagttctatttccacagcagcttcggcattggggagctgtgctgcagcaacacatgtccgcgccttttttcttatgttagagacaaagcacgagaaaataaacgaactcacttttccaacgaagagggaacataccggcttaggtgtgccagagaaaacctcgaggtaggctctgttgacgttggcatagtgattcatgctgctgacgaaaatgttcactttgacagtgttctgaatgtcggtaccagcttcctttagaattgcgttgagatttttcaatgattgtttctgtgatcagtgttagcacactgttatggagagacgctggtatgggacgaaccgtctgttcgtaggcgtctccgacaagcttcctcgtcacgggatcgatgccaaatgatccggagcagtataccatgccattgcaaatgattgcttgcgacaggtgtgggctgggagctggtgcctcctttgtgagaactgcggttcggcttgccattttattgttgttttgtggccgtctatttaccaattacttctacgattgagagtaatttctagcctaacccatgtcaagagcgacgttcttatacctttagcgcgagctacccacgcttatgcggcccctgaacttggatcagttttactccgatttcggtgacctggcaaactcggccagtggaagccgagtttttgtaaaatgtccccgcctcttatcgccaagacccgaaatcaggccctagaaccaatcgtagtccattaatcaagcgagcttcctcggagttagccctccgcactgggtcagtgcttcatttcccttgtcagttggtgttcaagccttttaatcacgggatattacggttatttgtagagtaacaggattttgttgtcttatgtgtagagaatcagtgccctttttcagtggtattaaagctttctggggaggggtgaaagaaggccaggatatgttgggaagaatgtccaactcccatccctataacaagagcgtagctagtctttgacttcgaacatatcatcatgcaaaataattattggttactcacaaggcatttctggtgaataacagcatattccgatatttataaaagcatccagcccagtcagtgatcaaaattcattaaaaaaaaacatgaaaaatgagttactatgtcttcatgacgccaattagtatcctggactaatgaataatcgatctattatttacagattgggagctcatgcgcttcgttttatatcgccgacgtacgtattctttgagacatgttgcacgtgacgacggtcaagagatcatgtgactctgcatggtcctctgacgtctatatcaaggaaacccgtgtccttacgtagcatctgtcgatctagtcttccaaggcaacaatgaacatactcgcttacgaccgcacttcatgcatcctctgtggggcccgattggagtccaatgctagaaaatggtgtgccaaagagatccgagtctgttcgtcgaacccctcccatagagctcccatagaatattcctctgcctcaatccacttgtctattgatagctgatcatttcggtcgcaaataaagtgtacacgtcctctgtcgattgcacccaagcgacgctttctggcgttgggatcatccgccatggctccattgtccaagtccccatcgaccccaatgtggtggacatgagcagacagccgagaggcttagatgaacgcgaaggtttcatcaaggcaagattgcacagcctcaagaggcaccagcacacacagacccttcgccagcatggaaccctcttcgtcagaccgcttgtccccttcctctggggctttgccatccattcattttgctgggacatgctcaacgccgagagtgcacccgatcttcaagttctattccaagcctgtttgtcaatgccactcagtaggagtggggcattagagtggggccatgactatattggcctgatagatcctgtcccaattgaggacccaagaggctcaaagctaggagccaaagacctgatgggggattggtggcggcattcaaccccttcccaaattccagagattcaggaactcgtagaagctgaacatatcgctccgagtacggcgcagcccatgcccgagaaaggccaggaaatacctattgcgggtgatcgtttcttatcactgccgacggaattacgagaaatggttctatttaaccttccgtcaaaagatgtctatgcactgaagctagcatctccagtatttgctaatatgcaactaccggacggattctgggcctcaaggtttgaattcgatcatgagtttggatatgtgctggaggctcgatcgtcgagacctcagttttggcggtcattgtacttcgccatggacaggctgaaagagaacccagcaatatctttatcaggtcgcttccgtgtttgggaactatcaagcatgctcaaacaccagctacgtgaagctgttcatccggcttgccatggcgagcctgttataggattgatcgaacctcagcatagtagtgagtggctcaagacccagtggcagacggctaccagagggctggtgaatgagcctgatttcttcgaatttggctgtaggccgctacggacccgtgttgttcaggtaccaactccgctcagactagatagagtggttgtttcgtttgctagggttggcaccgagaagtatatttctggactggaacttcttattcacaacgattcatcgattaagattgggtgcgctggtcgaggggagaagcaaattgaggtcgataagaaccttttgccgatttgcggatggcatctggccctaggcatgtcaggaatccaaggtattgcagctgtcatgaaggatggctctctgtcttcctgggttgggaaatatgaagatctacctcgatactcactgcgaggaggtggaggtgatcttcttgcgatgaaggcggaatttgatgtgagtttcgaagaacggggccaaaggcaattccggctgaccgttttaggcgtttcgcatggtctctttgagcatacacaccagtaacatggagactacgacatggataaaccatttgccatggaagtacctttgtccctggatgccggagataccacctgatcactatatcttggatggaagcgggcaggagtatgctcactggtacatgggaatggagggtgggaccgatgttggaaagtctcgtccgatcgatgccttttattttggtggctctcacggagagcttttgccattgctgaaggagataatagtctactcgcttgccggaacaactatccaaatcacaggcgtcgagtttacatataccgattccagcagagatcgcttcttcggcatgatcacctccgaccccgacgcggaagatgaaatcgaagagaaccccgaggaagccaaatttagtgtgccaatagatggtcctggcggagaaagaatcaaaggcatcgacgttttgtatacgaaattattcgataccaggccgatgttgaaaggtttaaaagtgagtggcaccagatggtctataactgtttgttaacctagtctgcagattcgtaccaatcgtcgaacagctgaagtgttaccagccccggtattaaacaagcggaagatcgccagtaatattctcgacagttccgagtatcccagccaagtccttgatcagcaaagaactgtcgatgtttctaagaattggattacattggaaccccgcgggcaagaactcgttggaatttatgcagtcttagtaagtgcaatatgtgaagaatgcttctatcttgactaatttagcaaagggttggaatatgatcgagaacttcggcttaatttctatgaacaggtcctgatgactgatattgggagactcaggcggggagcatagcatcatacagttactgagccccaggtttctttagctagcacccatctggactccagtctaagagaatcaactaaaacagtgtgtcttcaatgcagtggaggaattcgcgagaatacgttgagagtgaaggagtaagctgttaatatacagtagtaagcattcatgacgtttgtaaggttagttataattatgcgaattctatcatatctcattatttacatttcacaatacttttacactagccgtaattttccatcttcgttttatcagaaagccctagggtcttccttcgggggtaaccattccgcgccaaaagcaatcggtggagtgaacctcgcattgctcgatactggacttggctgaaagctggaccgtcccggggaggccaccggagatggggcaatgggccaatcgtactgtacaacctggttcccgtctccagttctcgcctgtggtctagtaggagctgtaggtggggagacgtatagccgactgtcatggcgaagggtggacggaggggcaactattccaccagttggaccaggctcaaaagacaagtgttttttcttttcccggacagggatcaactcagccccatcagatgtatcgtctgtatagtgcgccttacggcgtgctagccatgggagtttgccagacctggctagcaaaatcaaaagtgtaactacgccagcgacaaaggctgcagcgcctatgacagcaccaacgatcggagcaggcacacctgattcctgagaggtcaccttcgatggtgcgtttgttggagtgcagtgagctgttgctaaggcttctacagtagccgaagcatagtagctttgtaggtcgctagggagtgtcgcgtaccatgaaggagtggtgtactgtgatgcgtgcccggacaataggaagcacctggcttcggggtctgtctgggctgaagtgggtatagcagtttggagaatcgcggcgaggtcttgtgtaattgttgttgtaacggcaagggaagtgtctgtagggatgctgctcgagctcgtgtgcgatatactagtagtgatggaaacggtttcgctttttcgtttgtccgatgtcgtcgaagattgtgagacggtgggctgtgctgttgatgagggcttcgtggaagttgaaggcttgtctgatgtcgttggcctatctgatgtagtcgtcttgggccctgctgatgtcgaggtgggctgctcggatgttgtaggtttatctgacgtcgcagacttgactgtggttgatttgtctgactgggcggtctgaacggctaccgagggtttgctagacgatgagggactgcaagtgttgtccttggagcaaaccgacccagagccacaatacgaactaccgcagcatgtcgagcctttgggcatacaacctgtgccacatgcgtcctgatcaccctcgcacttctggctgtcacataccgagccatcagcgcagcagccatccttggtgcaagatgagccggcattgcaatagaaagtccccccacagcagtcggcgcctttgggtatgcagctattctggcaggctacttctccagaagcacaattgggcccatcgttgtcacgggcgaataggagtgggctgaataagtcccggggtaagagcctgtcgatagttgctttctggtaaaccaccaagaggtcattggcggtatgatcaagtgaattgtcagcattctcggagctgttgtagacaaggatgtctttaggaagagcagcagggctggcagccttggtcacaaatagaggaagcttcattgtaacgactggaatgaatgttgctgctggctcacctagtcctcggccagcagaggtgagggctgttctccttaagtctttaagcacgaagataaaaatttccgactcgggttcgtggcacttatacgacgagtgtgcctaatagtggagggtggacattgattaatcttacaggtgcatgaagaactaggcaacaaatagcctcactggcacccagatcgttggtcagtctagagacaccacactgggccatgactaaataaagaatcaccgctaacatctttctatactgtaacagaagcaagagtgatcggctttcagctttcaagttccctatgtgtagttatgactagcaacacggggtgtaagccataagattgctgttaactccaaccgttggacaagacgtgtacacatcagaccaattagccagggacatctgagttgcacgctcgccagctcctccagatgcatgtgccttgcagaacggctgagtctagaccatactggttccggcgcttacccattcaagggtgtcagccctgccaccgtctgacccaacaaaatttgcccttcatagtagcccatccagcacgatgggcttctgcttccttccccatggggagtcgggaaacctgaagacagaaaacgtcctacctacatatagatccttcttctacccttggggattggtatgagaaccgcctagatgatagtgatgcgacatgttcccctcgctggacttcccctccttgaaatggcggcatcttccttgaatatgaatggaagtgcttcttcctccttcgcttctgccgtattgttgtccgggctgtagctgacaaaacagcttccccctgtatagacgagctgagagcacaagttcaaggcacggcttccgattgctctgccgctccgtgtgctgcctgggcggggattgctaatgcatctgtgcatcctgcgcttagaccgagctggtgatttgctgtatgtcggctgctgtagctgcggactcatacctcaggctgaaggggaggcggaattcactcactcatggaggagtcacaccgactcggaacctcccgaaagcttgcatcttagcttccatctcatttccctggctaaacgttcagtggcagcgcaaggttgaaccggcacgctgagcaagatgggaccagctggtccgcttttaggggctcctctcacctggaaagccaccatttctagcatgctctagaagagtgaagcacttagtaggtgtcactgtcgttatgaggcgctaaaataaccggctctgcagcttgtgctgcggctgaagagaaaatccccatagcaatttccgctgcagcagcacagccctatcacagctgccatacgacgccactggcttaccaagccccttcagtctgctccagtgctcacgctgcaattatgatgcatgaaatgtgcaggtgcaggtggctgcttctgcttcgagggagtgacatcgtgcttgcagctcgcgaatcagagttggcctttggttttcgggggcagagcgtttgacacccatcagctcatccaattgagcgagggcggcaatgattatccgacagatggatgacgatgggctctcatacctaatcgccgagtgagagatatcacgccttcgggcacagccgccgccttcactacagcacccagtaaatatgcttacgttttccctaacctggtgcacatatgctctctaacaaacaaaatacctagtttaattggtcggacaccgacagtgacctttggggatctctgtttcatctccggtgagctcagtagtcgaccctatgtccaagcactcctttgcttcattgtcactaagaatacctaacatgaatactagttggctttggattttttatgatattctcttcttgttacttcttgtcgcgtaatccccaggtgttggtgttaagataaaatcctcaatcctggacgagaatcgggcgatgtgggatatctttcagtatttccttcccctctgcaaagtcgtcgaccctcccgtcttcatcccacaatgccgctaatacctttctctcacctttccatggggacctcgagtgcatgacggcaaagttctgtgttccaagctctgattagcactaattgttcaagtggtgcagggtagctcgagatgtctgacttacatcaagaagaacaacatctcccttctcccattttacaagtacctgtgatgactcggcaatgtggagcgccagatctaagtacttcttctcaatctgctctccgtctccgtatagtggaggagggtggtacgagtcatcatcgcccctaaaagggggctctgttgctccgtgatgtgtactgcgcccccacgcgctggtgacattgccaaaccacgtcgtcagacctgtctctttgtgaattcgaattactgcgcctatagagtcagaatttatctctctcgacttattcatttagcacatacagggtgtggtgtgggtgaccgtcaagctgccgtcctcgttccactcaaatacgttgctgtgacggcgcacctcctcctcgattttagctcgagcggtcttttcgtcatcgcttggttggactttctgtccatatgcgccgtatacgcttgttccggtggtagatacgacgtcctccttaccgtagcggtagacgtagcggatccccttcttcaggaccttttcgtagaactcgggggcttcggcttttattctcgaggcgagctggatgctcgagttaatcggtgtttctccacctgaagcacatgaaatattagtactatagacttgggcatacgaggagaaagagagtgtccggtcttaccagtttcggcgggcacaacggcagagaaggtgagccatgccgggttgattgttgaccagccgtattcgttatggggccaaatgggaagttctggaggtctacaacctattagcacgacgagataactttggtgggttaaaaaagctgccatttccgtacccttcgtttgctgtcttaacgttcttggccaggacagtccgtgccggaggtcttcctacctcctcatgtgctcggaatccaaaggcatgtgcagcgtcgctgtaatcctgcgcgttgttgattggcagaccgcggatgagaacagcacctccgtgtttcttcacaagaccaaagatcttcccggacttggtaagctcttttagagcctcgatataatcctgtaacgtcgctgaactgggcgaagccgcttggagtgctaaagggaagggggcatcccaattgaaccccaggtttttggtgctttgttgaccctcgaaggtgaattcattgaaagaaatctgagacgccatggctgttgttgtctttgagcggctgagataaggaacaaagattaacgcgtgcctcagttatctgctacgatcatttcaatcaatgcatgtgaatctcaggatgaagcttttaatcaacaaccagacgcaattatcgagaatggacagaaccgcgctctacacttgaacggcgagcaaggtgaaatatggatccaggattgcgcaattccaactttataagaccactatcccctgctctccacactattgacacggcctgggctataacgaattgcgtcaaacatgagagaagcgagggcactagacaggaaaatctctcagcggtacttttttctgttctccgggaccgtagagatgaaaaacggggaattgttttgctcaccgtatcatcgtcaatatgagtggattctggtggtcacgcaatcgtttcgatgaattgcctcaacagccaagcaaaacatggtgatgccgaacatacaagggttcgggaataaaacataccccatggacaccgtttttgcttcagccatgcacgtcaactttgttttaaggtgtctggtccgcttttgttagccctgcctgcattaaagggaagaagaaagggtagaaaagggccgaaaggaagaagaactgtcgatcatggccgatgtgtcgaatccatccggggcagaaccaccggcaaagtctgggggccccatccctacctcggacatcgaggaactgtcgacggccagtcccaagtatcattggttccgtggtgtctttttccaggcgacagttgttggaattgcggccttcacggcacccgggctatggaatgctatgaattcagttggtgcaggtggccaacagaccccgttcctggtcatgtaagtctgagcttgttcgtacgtttgatacgtccccattgacattctattgtacccagggccggcaacgcagttcttttctccttgatgacgatcacttgtctttgcggtagcattgtttccaaccgtattggcctcaagaacaccctcatcctcggcactacaggctatgttctgtactcggccgcattatacaccaacaaccgttatggtgtggaatggttcatctacgttggttcagctgcctgtggtatcacggctggtcttttctgggctgcagaaggcgcaatcatgctgctctatcctgagcaacacacaagaggaaaatatcttgcatactggctatgctataggaacagcgggagcattcttggaggcatcatcaacctggccttcaacgccactggatcaaggactggaaaactcgactggaggacgtatatcgtcttcgtcgttctccgtaagttgtacttgctcatgccctgcgtcctaacataacaaccactgactattttgtgatgaagaatgtcttggaccagctgctggtttctttctctcaccaccagagaaagtggttaggcgtaacggcacccgaattaagttgattaaacgtatctccgacttggaagaacttaaagcgcttggccgtcttgtggttcgaaaagagctgcttcttttgtaagatcccatgctgtgaaaattccccaaccctgaagtgggacggtgctaacacatcggaaacagaacacctctatttatctacatcaattggtgtcttccatatatcggctcctatctttctctatatttctcagttcgctcccgcgctctggcttcactcatttcctccttggctcaaatcactgcaacccttttgatgggtactttcttggactggactcgtctctcccttaactggcgtgcaaagtatgcttactcgattatgatggcactgattggaggctgctggatttggggcgtgatcatccagcgcgagtacggaaacaagccacccgggcttgactgggatgactccggttttggccgcggctgggccttgtatatcctctggcagatgaactgggctctgacatacaacttcggctactggctcatcggcttcctggcgagagaggctgctgatacgccccgactcacctcatatgtgcgggcgctcgagagcgctgggcagtgcatctcatcgggcatcagctctacacaaactccggtagatatatctctcctcatgtcttgccaatcgcgggtattaacggtatcttagctcatcgtatgtctgggcatcaactttgctctatggggcttggcgatagttccagcattcctcgtcgttcgcaaggtaggcgtcgattacaatggagctaaggacaataatgaagagagagaggaggagacggaaaattcgactgccaaatcctaaggagtagtaaaatgactgccgaagaccttggacttaacgcaggcaacagaagttgcaataagacaggaaatcccacaaatagatggcttcataggcagtggaaataaaagattgaatcgttgtttctctcatgagaatttggatgtattctttgactcgagctttgggagtttgaaatttatccgattcttggatgctggtgaactataaagaaaactggaacgcctttgtatgttgcatgttgcatgagggaatcaaagtggtatctaacgcccttagcccccgtgttatactttatgctttctaaaacccaatatagtgtttgatgcagttatattccagcaattccctgtggaaagcaatctgcgccccaagataagtttatttatcaaagatcagctcttcttgccatcaagcgctggatgggccatccaacgatagcaagagaagagatcaacataagagagcccacaaacagaatagctggctcatatttgtttagaccataactgccaagcgacagagatctagtcaatagacctgctgagatgggaccagtgacgatgtttccgatgcctttgccgagtgccatgagggaatacacaggctgcggatcctcggacagcatggtgccaaacttgggccagaagactacgtacgcgccggcagtgattccccaaacgatggagaagataagcaaggttgccagatggtgacagaaaccccacaagaggaaggcagagagggaagcaccaagggtagaaatacagacgaggatgtgaatgttgctgcagcggtctgtcagatgaccaaaaccaatttgcccaaatatggtagcaaggttatttgcggcgagaatcattgcaccgatggttccggacatgcccatgtccgatgcatacgatgggaggtacaggggagggaagtagtatgctaaaccctggcagatatttgacactgtgaaaacccagaacaacggattcttcaagaacctaagatcaagggcgtgcaagttatcgtggtgcgaagagggcaagcgtggcctgagaaagaaaagtgacggtgcaaccaaaacaaactgtgcgatgcagacaactcgcagagttgttttgtgtccatagctgctcagtaaccactcgagaaggaagggcaatccaacgccgctaaaaccacctccggcgtaaaggacaccgtacgcgaatccgcgatgattgataaaccattcgttgagcatgaacagaagtggcatataaagcatcaaaaagccaaatccgtaaagtgcaccttgtgtggcaataagagccgggatcgagttgacgaaagacgcgatgagaacagatagaacacaaataacggacccaatgaccgccatgtgacgctggaagcgacggaatctcttaacaatcggagctgcaataggagcgccgagaaaatagagactagtagcaacggtgccaataacagggatgttactgtcgccttcaaactcgggctgtcgggagtagtaatcttgaaagactccaaaactgaccgggaagcctagaaacaacgaaaagggaggccagttagtttatcccctctcaattcgataaacaaaagaggtaaattgagaatcggcgtaccccaaaggagagcctcgaccacaaaacatgcggtcaagtacttccatgcttccgggccattgtcagtaggaggcagggccggaagtagttggccttggccaggctcctcttctcggttttcgcagtcataagtagcgccatgggtatccttctcagatgccatttctgtttaacttaggggcgagcttcctagagtgggcagaaagagaaaactgaggatattagattgaggctaagcaatggaaaaacaaacgtctggggcgtatttcttttgtatgaaactcatagggctataataacctatctcaagcctccactacccgtcatatcccccgccgaggaatgtcataaagattattcggtgtggtcaagacagccttccggcccgggagcatgatccggctttgcgaagatgttcatattaataatatgtagtgtcagaacacgggcaattggatcgatgagtcaagtagatggaaatttggtggggagaagagggttcattacgttattcattcttgacgaactccactgaggaagttgccgatcaagtgaccggagaacgccaggaggtgacataattgtagcaccaaggcaacacggtttcctctctactgttgtatcaggtttaatgtcacctcttggcgattgctcacacataagcctaggatcggtctagaagtctacatccaccagcgaatcgcaacacttgccggcagcacgatgagaacagttctccgaagagctacctctttggtctggcaccgctaactggccacttgcgttcgcattttctccgcccagtacgataccaacagctgctcctattagcgttcttgtctggcactttataaatagcatgaaaccaggccaacgagaccttcatccgcttcggacgactgattttgtggacaggcttttcttctagaagcctgtccacaatggcaagagataacattgtaactgatctttactacgagacttgcttgaatctccctgtttgctggtgacttattgagctttacataatttatgacctctcttcgagtacagtgatgaacctgattttcaattcccggctgtggttaacccaagggacggaattcgaattccgccacagactgggttcgctggtttcaatgttctgatttgtgcaacttgcttgattgtcttgagggggccattggccagccctggctgatggtggtaaattatgagcgacccctcctccggctgcggagattctagtccctctcggtaaaagcgggatgcgcccagaggccggaacaagtatgttgcactttgtgtgtgtgccaagaatgtcgacggagacaagtcagggtaagagggtaaactccagctccttgaccatgtcgatattagcagagctggtggcactcagtgagatgatcaaaagccatgatgtccacgatgtctggcgcgtcatctcaaatgcgtgttctctgctgagaccgataatcgtgactcaccctcacgatcatatgtggcgcagcttcagaatcgaatacaagtacttgaaaacacaccccaaagtctagttactgtatatcaagttgctacagatgatacgactactacagatgtaaaagttcgctcatggcttctcctgtaggctcatacgctttacgtagtgacaatgtcaaacatccggattctccgtatcagctgcatataagcccaggtctggaggcagacggagctcgatttttcggtaccacaagcggacgtctcgaattaccatcccgaattagccctgtcgcgagacactgcagtacccgctgatcaacacctgactaccactgaagaggatgagggagctgggcgctttgatgcatgctgtgaactgattaatattcatatagttactattattctgcttctattaaagtccctaacctcccttctctattattattatatagtgctgaaactataatcaagctgttaatttataaaatgacccattagcatatcagcagattatgtttatagaagttcaaattcggcttcctcttcccagatcaaaataacggtattgtacgtatcttacattgaataaagttcccaaacccagtcttcaagttaaatagccgccagcgaagcaaaccaggactcgaagagagcaatttgatcatcacgtgcaatgatcttgggtccccaaccgtcaccaagctcctgagttgtggttgtactggcattgacattgtcccagtaaatcaaaccatcgccattggggttgccgtgtttgataaagttaacccagtagttgctcatattttcagcaatctcatagtcctcttcctcccattcaccgtagtacacattgtagagattgtactgcgtatactgaatctccgtcatgtgggcagcgccggcgttttgtcctggaggagcatgatcccaaagataggtccacaccgggctagttctgttgctcagccataagttggcccaaaactgcgtgccaactgtggaacgatccgtgtactgtgcattctgagcagcggaagcagtggcagagtcgttggccgggtaagcttcgaagaatttgtccgcaaagcttgcgaaagtgctattcaagctcgagaggtatgtcgcgagtgtgatatttaacccataagaagcgccgctttcgtcccttgtattgccggttattatgggaacgtcgtgagctagaccaagcttcagcgtgttcaggtaagtatcaggcatgcagtaatagtcgagagttcccttgaatgatgcgcctgatgtacctccaaactcagaagtatcgaggctctccatcggcaaggagcgcatgcagctaatcgtggaacagttgacacttcccataaaggagataccgtattcttcggcaacgtcgtaggtctggtagccttcagccagctcgacagcggatggatcatgaggatcgcgaagaccactttggatgatggcgccgacaatcttgcctttggtcaagggactgtttagaatgtgataggtcgcagcggaaccagcggattggcccatgacagtaatgtggtcagggtcaccaccaaaggaagcaatgttgtctcgtacccattgtagagcagcaaactgatccagcatgccccagtttccggagctattgaggccgatagtggctagattttcctctgtcaactcaggggacacaagccagccggttgggccggtacgatagttgtaattgacaaaaacaactcccttgtcggccaatccagcgccgtcgaaacgaggatcagcgttagatccgccggcagggtagctccacatgacaacaggcagcttgtcgtccgtagagttggctgcgctccaaacattaacgttcaaacagtcttcgccaatcgtggcgaaagtggtgccggacgacggacaagaatacccatagtccttggcgtctagagttgtgttccaagctgtgacgttttgaggaggacggaaccggttcttccccgatgtgtcagcagcaaaggggatgcctttcctatatcacaagtcagcacccgattgacttctcggcctgcatctttttgcgcctaccagacagtgactttttgccagttggtaagattcaggccggcaacactgctattaaaggccggatgcccctgaacagggccattgggggtttggatcacggtctcatacagcgccgccttggcgatcgaagcaagtagccctaagacggtggagaaaacagatgcgtgcatcgtaggtattggtagctatataaaactagcttgattcgagcgagctatgattagatagaaaaaagaaattccatcggagagaaaacgctttatatgtcttgattcctcgcccagataagtttggtacagtacatgctctcttttgcagcataaatgttttttttttcaaatgacgcgtccgtcaaagccatcatgccatacgccagagacgtacgcgtcctacccttgaagcaaacgtaattgttatgggactgtcccgaactagtagagtttcaaagataaagagtgacgtgataagagaacctatgctataacaaatcttgccgcatcgctcagtctgctgtctttctcgctgttttagactgctccttgcgtggggtagtattgatcaaagaattcagggacactatccttaacatcctgaagctacacgagttgcttgtggttagtcccattcatctcaagcaaagcacgttccatcacggtggagaataacagcagcttagtaaagcgatgaacggccaaataacctaaaatactcatcaagcttagatcaataggtattcaaagggatttgaaggcatcgtcggtggtcatcatcgggatccaaattttgcaataatgtacttgcacatttgtctggaatgtgctgtggcaggtacttctcttgtccgcgaccttgctcgatccgctaggtgcttcgttctgagaaactgttagtaaaacaaaactgaaacgaacgtataaggatggacatgtttgacgacagcggagggggtatgtagctctccggcgctatgaccaccggcacttgacacaccaaactgtaatgatacctgttggaacggattatcagaaattagaagaagtatacattagtaaaccgaggtactatagaatttatacggataattaaaatataagaattaaatttataaacatatctattttcttaaaatagaagaattatccaattaaattaatcggataagaatcaaatataaacagttatatatgaatgttttttttttttgaataatctagaagagctatagataactaagaaaacatatagttctcctaatttcttatgatttattctaaaagcctatatcttctctaccagcaatacgatctcattttacagcgatctactttcacaaactgaattacatttgtgggaacagccataaattctgacgcctctggaccttgagaaattccactacatggaggcgaggtacgaagtgggatgaagtcacttcgtggagcccaaggagtttaatattacgcgaattctccttgatttgtaagaaaggacggggcgatcgaccgcgtggtgcaaatgttcggaatataaatcatgctcatcaccctgtctaaaagcctctcgtagctcgaactcagtactcttatgatatttgcattttacttcagtgacctcgtatagaaataatgtctcatctctaatactatgcctataaaggccagggagtcagaaacagagcggcattctcttacaaccaggccgttcgagtaggcgatcggattgaatgctctggcgaaggtacgttttagccgacgaacacatttcataccaagtgaaactgatgtctttattttatttgaaggaggatggcatcccgaaactggcgtgtttgagaaggaaataaatgcgcaaattgaccttgcgtttgccaacgtggagcttaatttgaaggacgctgggggcaaagggtggtcgcaggtctttcgcgtaaactcttatcacgtccctctaaacagcgaagcattggaagcgatggtacggaacttcaggaaatatatgccggaccaccagcctatctggacctgtgtgggcgtggcgcgccttggagaggatgatatgcgcattgagatcgaggttgtcgcacatgacccgcaagagaccaaataggaccggtactactcgtgttaaatataaaatctcttgcgtcaacactcattttcgagaaaagatagacaccttcaaatccgtgccgaattctaagagctcgcgttccatacttgatattgggaactctgttctttcataggactcccacatctccatggttcggggagaatctgcgtcaagaaacggcttgctatctctaaagatcagtctgctttctaacacacattttgaagtttcctatggtcaaaggaacatcacatacctcttcttatccgccacaatgccgctgtcccagaaggtcgcgataagcatagttggtttagcaatgtcggcgatgatttgtctaaccggtgccgaggcctttgcggaaatcacaagagactcgtcatcaacgttcacaaaagctccagctccaaactgccctttgacttcaaatcccttttcccgtaggaattttgctgtgcagtccctgtacccagggtcttaggcaatcagacggacgccggggttgtatctcctgatctcctctgccacagtgaatgccatggcatgttgcgtcataggaccagaagttatctgatcaatagaattctccctttttgatttatagatttccagatgggcaccacccgccaagtctccaagcccaaaacagataatttttgtaattttccgggtgcgtaggtactggctctcaaataagagcttgctcaactccactttgaacaaattgcatgtgatgcttgttttccaaagctggcgtctgatctcgaaaagctcttgccagttcttaatcttgtgtttaaaaccatcggccgccgtattcctccaatcgacaatatacgagcacttgtgcaattccgctgggctttcaggctcacacagcaccagagaccaatagccttgatgcttgacgtagggtcgccttcaattgaaaagtttagcaacgtgtttctgccagtatatgggagacttggaaaggactgaccaaatcggccgctcaacctgaaacccggggtttttgatccgaatttgtttgccttcaaggtcccggagtgtaaatacttccagatgaaatgactgctccaactgcctctcaatgtcatctaattcgacttttgaccagaatgctatcccggaatgatagagatctgctacacgctgagaactgagcctccacggtttgcagccatagtcaagaacttgggctggcgagtttacgggcccttgtttatcttgcttgccagctgccatggcgggtgagaagaaatgatcgcaagtatcggcccagaatgacttgtcgatgtgtagatgggaaaggctgaatttcaaaggagactgggatggcacccctccttatgtttgtataggcagtgactcagctcgctgcctaaagtggaaagatggcacaaaaatgccaggcatcaatgcttatggaaggtggacgtatgtaaactgcatgcatacatgtaagcgttttggtagcaaaaggcgttcctacaaccttctattcgccttatccttgggtatggtgtcaagttgttaaattcttagtgtttgggaatttcccccttttttttacagcagctgccgcataactgcatagctctctcacttactactacccattcgctttatccttgacactgctacatggccggggtaaaaccggcaccagaagattaattaggaatacgtccccaatctacacatttttattatttgagggtcaatcttccaccatatttcccttcttttttcttcgcctcttgtcgctaaaggaaaacgagggtcgaagtagatgaatcaacccataccgagaactgacattttggcgggcagtatagtatccggacttgtgctccgggctagaatgaagattaggtttcattcaatcttcttgactaagtagttgagcaagccacaacggcaggctataaggatcgggtcaaatttaacctccatatgggcaaaagcaacatgtgtttccgcgtcgattgttcttgaatagttccacatattgattgacagctcaattacggcgagaataagagattaattctgaatcaacaccataacatgtaaatttcaaatcttggcaccaagttcaagaacattcaccttgctatactcgtaccctgatcatcacatggcttggtctgtgtctggaaagcaatgatagactcggataccgaagttgacctgttgtggaggtggtatggagtcaccgctgcagatattccatcttgatcattgcctgtcagagttctcgaagaaatgcatcccctgttcacactgctacgactgtcatcggcgactttgtcggggccgctcacttttcggccggagctccggatcgaacgcggagtttcggaatgcagatccgtcccgaagttccagaatatctcgctccgaaactcctgaccacgtcttgcaccgtattcgaaatcaatagaattgccaaatcgagcctctctataattatatcaacttttcattcttcaggccaaatttttgtctcttccatttcatcatcccatacccagcagttctaatcaaacaatcacacattcttaccccgcttcctaaacagagttcctcaagatggcagcaacagcggacaagtcaaagccatatattcctcttgctagtctcgctcgagatggctggtcaacagacgaggaagccaccgccacttgcttttgtggtgccgtgcagctagtctttgtgaggctccatcccttctgattttcatcccctcttatcacttgttaagctctccatcatcatagatgctaacaatacttacagccaactcaaggacccggtttgctcaacacattcgtatgcaactgtacagattgccgcaaaatcaccgcgtccatgtttgcttctaactttacagttgcgaacacgcacttgaagcatgcccgaggcaaagagaatctgaaagaattctctcagtcagatacgatactgagaaaggagtcaatgacaaatcacttttgctctacctgcggaacactgatgtaccggaccggttcggggtggcctggagcgagcattctccgcattggcacggttgatgactttaacctacatgaaacaaagttgaggccacagcacgagatctttgtaaaggatagggtctcttgggttagcggggtggaaggggctaaacaggtggagggattaccttctaaactgtaacgcttagctacgagtgttacgattctgcgaatgtgttttaatctattccttattgcaccctgtgacacttgaatgtgacccgtcgcacttgacacttgttgctcaatttgtatgacggctaatcttctattgggtgaagtgagacagtagctcgctagcaagtatcacaaatctgaaatgcgggaatgggagtgattccatatggcctcaacagtgacttaataagactatggctcgataacgaatattttaccagctataattcatttcagatcaccccgcctaagacaacgcctctgtgagaaccaatgacactccaattgtgacacttcaatgcaaagtattaaagcctcacggaattacaggtgacaatggtcgctaaacagtttccaaaagtgccacctatttatttaccaccttcctatacttccgttgccctttcacgaggaccagtatactcttcacctgcaacccaaactcgtttgacattccgtatagctttaatatcggcaatgggatcccccgcaatcaaaaccaagtctgctctctttcccggctcaataactccgcggtcattcaagttccagtgcttagccggcaacaccgtcgccgaccgaagcacctctagacttgtcatacccgcctccatcatgagctctagctcgtcatggaatgacttcccaaaagaaaccacggcagcgatctcgtgattagcatccgtgcctgcaatgatcgggactccagcctcgtggtatatccggagcgattcacgagccgactcgtagctcgtttgtccaggtagatctagcccggcgaaggccttcatcaccgataaagtgggcacgacaatctggccacgagacaggacctgttgggccagatctgcggtgattggcccgtcaagaggagtgtgatggatctggtcggcaccggattgcatagcttgagcatgagagttcgcatcggccgcgtggcatacgacctgctttccatgcccatgagaggctacaactaatgcattcagactctcttgtgagagaccgggcgtttgtgcgatcaatttaatgaagtcaggttcccatgagatttggtcgttgacccaacgggtgacatcctcctctccttgtactagtaggtttggctttgagatcatgttctggatcatgttcccgtgtgtacttccgggagcagcggctggggctccagcagagtagatgtcgacgagaccagggagcttctggaaagagtggacatgttctttggagaagcatgccagctggaaagcggtggtgatgccatggctagtcaaagattggaggtccgcaatctttcgtggatgggaatgggattcgataaagcctggaagcagcacacccccttggccgtcgattcgatcacttattcctgaatcatcgtcgccaattatattgccatcaattatcacggtagagcgaggccttattatctccccgtcgaacaccttgacattgtcaattgcgattttgcgatgagtagatccagagtcactctcagacattgtgccagagccaagaagtgacggtcttgatactaagtaatgagctgatgctgatgcgacactagaggagcagacttccaagggaacggagaaagaataggttgagtaggataagatcagacttgcagttctgaagaatcaagaagatacacatcagactgcccttaaatagtaatacctcggacacttcggacggcatacggatacaccataccaaattgaatcagaaaatcgatacatggcgtcccagctaaactcaattgaatccgtctctgaagataacaagacgcatccgaagagggtgatgcaatcatgcaaccagggtcatccgcccgcatggagccttccagctctccgcgcgcgcttgaaagctatagaaccttggctgaggctgtggagccgatcgcagcactaactgaatggcgtaagaagcgcgattgagatggggttgtcagtttgctcatcccgtgatggatggatcttctgccgcgatgcttgcataattatctaatatcataccactgtaggtggagcctaattaacggggatatatgattgtatgtcgccgtgaattggccaggtctacatcctattatacaatcacaaattctcagtcggttatcaatactgtcaaactgtctccctggccaatatggtccgtacaaagaagcgggcgtacccgaacggacccccatcaataatcttgccaccaagtcttcacaagatagtatccaataatcgtacttttaaagatcacactggccgaccggctttaatgtcgtgggagagcgtggggtttacgcgtcccttgcctcccctcgcctcctgggtcttctatatggtccatccggatgtgccacgtgacttttgatggctgtgcatttagcagcgggcttgacgatggccacagctggggcagatgcggtagctttaggtacgagttcttctttctgccgggtgctacagctgaggaatgctatacgcactttcgtgggagatggaggcttgaggcaccatctggcgccagatccgcaaggttaagagagccataaaggacaagcgagacaacgacgaagaagtggagaatgaggatgatacagcccaacagtcctctgatgatcaagatgccgccgagggtgatgggcttcctggcttggtatggccaaagtgcgatcacgactgccgcaacatctgctaccgtggctggttctttgtgtatccagatacagatatccagtgtcgtggcgctgctggtgaggctcgcgatgtctatctggtcacgtttgaccctatcccgcaggaatggggagaggatgaggatcgcaagtttgacccgatggaatatccagtccattcagaaaagatgaaggcccgagacgagtattatgaggcagggcttttcggttggatgaaaatgagaaaaataggttcgcactggaagcaggaggcggacattgccacgtgtaaagctctggagctgggttgggagtcttggtgacgcacactatacaacctttgattttaacccccaatgttatttactgtcgccatttttccttcttgctccttatagaacaagtgacttagtacggccctattaagccgagctcagcgtctaagaaactttgatggttgctcgggattcaaatgtctgggtgtagagggtttgcggcattgtgcttggtcaatgcctgtgagaacttcagatttggtgcttgaatataccctcccgttgtcggtacatgatctagccatgtcgtaccagttgaactgctcccaagctccgtcctgtatttagctgttgccgccgtcagccaaccatctagtttagaggtttagtcgatccagaagcagtagagctcactcaagccagccatagattagtgcttgctgtatattgattggatctttccagtgggcgcccgcgagctaaaacaagtcagccagcaagcctccctgacatacctaatctgcctcagggacgtgagcgtgaaaacttacattgcgatgcgctctgcgtgcttgcgtgttgcccttctcgctcaaggcgctggggttgttccctcggaagaggaagactgtttttcttccattagccccctcatgagtcaggaccaaacacccaggctgagtataactgccaaagcctatggccgattcgttccataggtcgctttgagaccacccgctgtatttctagttcaaaattccatgtggagatgcaatcaaatgacgggcaccgggtgagatcgctggatgatttgtgctctcgactggagcgcagcgccaatgccccatacctggccaagcttgagcaggcagtccaaggtccataatctctgctgctccgggaggaaaggaacctcgttgacgatgtgaataaatcgagtcgcaaaatatgctcccaaggcttgacctctttggccaaccaatgggcgcccttcggggtcaacctcacctatcatgaaggggacagcggagcagatcgagtctgcagccgactgcatgccaaggttgatgacgtctcgagataaaggtgagtcataccgcattgccgtccgggataccatatttaggccttcattgattgcccctaaaagttggatacggctagtccagtacactgaccatcgacacccgtcttgaatctcggggaaggtgtacagcttgcttataaatctcagttcaggggatattccacctgatgcaagttcaacctccctgggtaattgctccggtagaagggttgacggccatcctgcgagctctctttcggtttcaaaggccatatcaagagctctgctgagctcaattaaggaggatgagctgtacagcccgtccgcgttcaacttggccagccgcttcatgtctcgacagaacttggacacattgccgtacatgtgatttaaacctgattgaagtggtctctgaggccccttggctaggtcgagcgcgtccaagccatcagcgcaagatttgccaccatccatacttcgtacttgcagtcgggcatgtattgtccacagcaagccagcctctggctcactttgaggcttccttggggctctcgctcgcaaaagttggaccagacccgtttcgtggggcttcatagcattcacgttaccactcaatgcctagagttcaagtcaacgaaaagtaacaaacggaagagtagtagtgctaaccaacctctcgcttctgaatcaagaaaactgctgccagtagtgcagcatcatcctcgtcggaacaagcccgaagcgccgtgcccatggacctcaaggctatgctatagagttggtccgccttgagatgaagaatactggtgcttgaaacatttgcgaggctcgtcatggccacggcattcaaagagtctcgcagacatatattgttcgggtgggtcgatagtaggtctgggaggaactggagatagcccaatccatcggggctgggggtgtaaacaaagttcttgaagaagtaccccatggcgtgctggagccaatctatagagggctggatattgaagtgtccctccagcggtcgctgctcagagttggcggctgcatgttttggcagggtagtccgagatgtttgactgggaaagtcgtcattcatggacaaaaagttactaatttccagaaatccggggcattttctcctgcccttgatgcaacggcggcactggggcttctgttcgtcacactactcggtcgactccctttgtcagctcggtcccgagttccagttgagccgcgatggcctcagatgccgcaccttgaccttcatccgccgacaagcgtgacaccccctgctatatttcggtctggggggcattttcaaacctggtcctttaacaaggtcatctattgacggactctatgatcagacgacgtggtgaattgatggcgagtcagacaagacggtgaaacaatgggaaatgaattcccagcttgattagtcagtggccagttccagcaatccttgaatcccaaaaatggtacctaccctatagatatccggctatatagacccaagccactgacacgagataaagagtatcatccgatgcatagaggctctagaagatgtccaagacgatattgatagacgttaatgtcaaaatctcaatttaaagtatgtttgctttcatttcaagttgccatctaggatttccttgcctgtatttttcgaaactattcagagactaatgagttctaagctttaaccatgaaaattttgcaaatcaaagaaagtgatttcgagctgtccgagagtatctcactatatttgttcctcattaaaaaaaaagcatcatatcctcgagttcactgcttagatgcttaggaacgcaccccatcccttgtttgcaaggcgaacaactgaggaggtacctagtaacattccattggctaagtccattaactccgggacaatagaagatcgtcagcaatcccctattctgctaagcgtgtgcgtagtgatgaagattctgggccgagtagccgagcagcccctgtcaagtccaagaagaagttgtgcggcaatagaatcggctttttcgcgagtgtcattatcacctctaaatgctcaagagacgaaaattgcgatagagaatgcctcggaaccccagcaacgatgctgcatgctggacatgtcggcttcgtcggaagagatgcgatagggcaattccaaaatgtggaagctgtctcgacttggcaattcaatgccacaggagctcccagaagcctgaatggatggacggtggaccacgtcagaaggccatgggtgaaaaaatcaagaagtcgattagagttggtgcaaacgccagacgctcgaagggcgaactgccatttcatgtcacttcacagcaagactacagttctcgacctggcgtgttggaggttgcttcattccctgagcctgatgcagctggagatcaatcgggatcatctggccagcaggtatcaagaacaaggtcgtcgtcggcatccccaaatacgggcttctcacatatctcgcctggatttgacgagcacgtggaaaatatccatccagaggaacggttggcggcgctgggtccagcttgggagcaagacttcaccatgatattcatcgattttgtcttcccgctgttgttcccattctaccgaccacccgccgtggcaactagcagggcctggctgttgtcctttgtcaaacaaaacagggccacaactcacgctgtactgagcttgagctcattttttttcacttttgggctggcagatgtcttccccggaaaacatgacgcatgtaggtataccatgtgggggcaagtagttgaccaggctcgtatggcgttcggaatgctaaacgtggacttggcctcgatgatggagggtggtcgccagccaacgctcctggagagggcacggatgatggctaccatcgtccaccttatgatcttcgacctcttcgtggggcggacatcggattgggaggttcatcttgcgcctgcgctgcaaatatttcaggatattgccaacgatgtgggactgggatctaatgaggaggttggaatatcggttattctagaggccatgaactggccccggccatacttccccggcttccagcttcagctctggaacccggaccaggcaaactttcgattcttttcagcgctgcttattgtgattgatatcttagccagcacgtcactccaaagagtgccacgtctaagccatcttcacggcaagttactaggaaatgtgccccctgaagagataaaccagcctttagatctcttttcttttgttggctgccaaaattgggtcctacttgtcattggagaaatcgccgctttggatgcaagaaagagagatgaggaaatgaaccaagactttgatcgaaaagaattcgacttacgagcaggtagagttctcaagacactcgaatcgggtcttaaatctatcattggtggcctacaatcgatccctatttttggctcctccttgtggtatcagcctggacatagcaactgtgatggagttcgttctctcgtgccgacaagaatatacgctcatgctgcgcatatttaccttcagacagttattgaaggccccaatttgaagtccagttcaataaactggcacacaaattcaattgcacaattgatacgagaattgcatgacccgagccaaatgcgcactctcgcttggccaatctgtatcgcggggtgtttttcttgggttgaagaagaacagcaacgcttccaaagtagtcttgcctctgtgggagacattcaatcgcggagtgcagctctggaggcgagcaatataatgaagaaagtatggagttgccgagctcgcgtggaatcttacaggtgggacgccgccgcctgtcttggggctatgggttatccagcgcttcttttctaagattttgcgttcaaagagagaaatagtattcaatctgagttttatatgaaatgaaacgagactatacggatacaaaatgattcttgatcactcttctgacgcaggcggtgtatcagacattcttccaaggggccatcaactctgccacggtatgtgtcatgatatgagggaatatcttgttcaagctcttttcatgaggcatgtaacacatgccataaacgtgatagagaccaaacagtgaaaatctccgttgaagcgccggcttcggaaatcgcttgtaacttgcttggtggataggcagctcggtcatctctcctcgctccagtttctcgattggatcgtatgcaacgttgaacttacaccctaatcgccgtggtcagcatctcctaaactgagaggtacattgaggcagtgatgaaatagggtagacatagaagaagccataccaacagtatcttctgcgatcctgaggatctcgttatgtgtgacattgtcgctataacaatacatttccgtctcccatttctcaagacccaacgcggcctcaacaaagcgagcgatatcaaagctataggtgaatgaggcaacatcttcacctgagccaggaatagctgcagctcgattagccatgtcaatatgaatgccatatacacccatgtggctacggatatgcggcgttccgacttgatcaatgatggtgccattgtaaacagttgtgaattcgaggtcggtggatcgaagtgtctcgatggtttgatgtcggataggtaagtaaggaagatagtatttactagtggggagtgttagcagtgctacccttggagagttgactttccttcaagtcactatccggaatacgtacgggtcattgatcggcatcgaccagtcacttgagatgaagcggcgtgtgattgaacacccattcgctgcatgaacaagtgcgatttcagctgccccagactcggggctgtttatctgcagagcagaaatgacagtgctgaccttgtagctctcaagcacgtcctgcagctcttggggccttgagtagtctactgcaacgaccctcagagctgagttgggtaggtcttgcgcctttgagtttcatgtttcatgttagtaccacaaccgtcaggcatatctcaatgtaggattggttaaaatactcaaacacaccttgcgggaaagaacaatgacagagtattctgggttctcctgtagagtttcggcaatggtaaggccaagtttgccagtaccgcctgctacagcgattgtttccatgtttagtaacgtctggtctttggctgacttgaaattgccgatacttatgaagataatgatggggggaagaagatgagatgtagattctgggtgtgaagggaacgatcgagctcgtatttatagccaactggcggccatcaacaagctcagggctcttcatcctgtggattttgctgctgacactggtcctaattgggaaatgggcgcgcgctcaacccagaagcagtattccgccttgaagaaggtcatggatggttggaataatggtgtccctcccgagaaagaaagctggccatcccagccatttacctaattatatatgtacatcacatattagctcgctgggctttgcaatggtggcgagtaagtcggcagccacgacaattggcacactcgatgagcctgacactcgctaagatatccttggccctaatatttgtctctacaccgaaagtacaattacttggccaagaagtgtgaggtatggcaatctatgatttatgattgggaaacttgactttccattaggtttatcccaccacaccctccagttgtgttggcttgtttcccaaagagtgcgtcaacattaggcaactttccccccaattcatgtgatgcatgaagacgagattgttttgggaggtttgatatgagaaacaaaagagtatatcataaagagcatagacgagcatagcttcgatctctatcatggaccttgcccccacaggaagaaaacaaaacaacataaattggagtgcaaaacaaacattaaattttagtaaagagagtcatgcaggggaaagagcaacagcagctcaacatgatttctttttgctcttacccttatatacagctagttttgagctctggggaaagcatgtcgttcatactgttgagatgtctccttttcattttgttccatcatttatcagcctcaagattcacagacaaataggaagacctgaccgaaaatgacacgggaagtgaccctagatttatccctaagtcaacttatgcctgatccaggttgcttgccccttgtttccttcgcgtttcctttgccgtaaccctggtactgatggagtttgagtgcagagtagaagcataaatggaagatgccagacccgatgtctcaatagaatttactagctgtgactctgatatctggcagaaaatgttgcgtcgtttgaatcaccgcgtcggcttcgggttgttcaaggtatctggcaccgcttgagttctcctttcgtcctcctgaatatccgaaccgctgacgatcggttgggcagtctctttgggccacggccaatatccacccatcgcctgtttattgtagacggtgttgaagttagcacttggccgtgatcgatcagccagataaacttgcttgccatcccaatcaaaagccttcatgacactaataatatcagcttgaagccagctgaattcaaaattgatgatagcccaaggtttcttggaaaccacaaccaacgtagcgtcccattcatattcgtccttgattgtttccaacaagcgaatcgttcgcgtatgtctccaacaagggccgcagccaattgatcttggttttgtccaatcgtccaatttgatgaactccgtccccatagaaaccttactcgccgacaagtcgagaccagtgcgcatcaaacgcggtatgttactcactttgacctccaccactgcacgccaatctggtgaagttttcttcccgaatatccctttccaattggaattggactcagggctgaatcttataatcaaattgggttcggaatttttccatttccggccttttggacgtcgtatatcccaagcaaagtcaatcatacgtgtcactcgttctgcgttttgatcctcattgtagcttggtggacgtgtcgcctgatcaccatcgtggcttgggtttagatcaaagcttattagtggcatgacgagtgatgaaggtatcgataccttggattttcggcagcgtgtcttcaagttgtgttctggtgagttggtgaaggtatatctgtcacgatgggagcgatggaccattttgacgatccgtacaggtatttatacctcttctctgcgaatgagcgtatgtgaaattcacgtaaaattcatggtggactgaactctcctttacccggcagtaaactttgcgctttccagcctcatcattgcccaagtgtgcgttacgaagttagtaaagggatgtgtacgggtaaagcctgaccacacagtactctctgtgaagctgcctagaccaagagccacagacacttgatttacaacaatttcaatggtcagcaaacacccttgggcgagagttgagaggtatgggcgtgagaactcggacggatcaggctcgcttagcggaaatggaaatattgataaagttacagagccaaaggtgtactgcgccactatgactcctacacaggacaataaacctgaccgcttgatatatgcagatcctcctcattgttagcacaaacgataatacacaatcatgtgttggtagttgcaacacgccgctctggctgcgtacaactggtagcaggtcagcttgcaaaagtggtcgctggcagtgctcatcacctgagtatgaagatttccaaagctttgccactagtgggagttttggacgccaccttaaacatagttctatgatcccaagtcaagcccataatttattcgccccatgactatggtgaagactaaaagaaggtatgccctctaagttcatctatgtgggcgactaaggcaggcgagtaccgaggggtagtgacgagagtcagggggaagcggcactgtcggttgtctgaaaatcttctcgatatctcctccgtgtcccagatcacgtcgggtgaggctacaaacaatatctttgagggtgctctatagggaaacgtgtgccatttcatcggcataggaaggtggcccgtagacgatgtttactagctctttattggacgtcgccatcatcggagtcacagagcgatggcgaaaggtaccaaggtaacatgggcagcttgagtgtgaatggtaacgtgccagccattcaatcagcccctgcggagacgatgctataactggccgctccatgagacggtctgatgttggtttgctgatttgacgtcgaaacgtttatctaatcaagaaacaagtaaatttccggaaaaaaagaaatgctgtcctcttagctgcgttctcaagcctggcacctaagtctgctatatatatttaggaagcatgttatgtatattaggaatgagagaaaatcacgccgctacctcattgtgatattgagaatttttttttttttttttaaaataatacaacaaataatcgtaatagccgattagcctatactagataaaaagaacgtcaacttaacgcttccaggccttatggatgctttttcaaagtactacgttcctgtgatggtaattggggctaatctaatgctttctaagtggccatcatcagaaggaaccctcaaaaaggcttatggcttcgtcaagatagagcaacattccttgagagcgttgttgctttgcatgacggatcctgagggtaggtttccccccacacagcatttgtagcaccgaacgggacagtcaacgacaacatgcggtattatcagaaccttgatctttatctcgtgggcgaggaaattataggaaggtggaatcagaatgggtaaagctttagcccgacggggaaagggctacacttgggttccgggacgtacagcgcgactgtatcggttgaattcaaaatctccttcttgagaagtggtgatggccgcgcgtcaacttctcctttgatattacacgcccgactagggtcgcccaataatcactctacggggtaggcggaataggaaagtgaccacaactgacttcccattgtgtcaggtgagagttctctagcggggcacctctcgagcaagggggagggtcttgatactacaatgcacttgaaagcgtactttcttcttgggaggtccaaggtgcggatagatacaagaacaaatattttggtaccagaccaatggtaataggcggccaaattctatagtaaattgcaattatgatgttgatattttcgttcttacgaatcagaactttatagtaactatccaccatttacatatctagtacctcgtggaggcctctcagtaccaccctaagaaggcttctctattttaccgtggttctatgttaccatcaattactattcgggccgtcctaccctagcaactggaggaggggtaccacgtgtctaaagcttagcatagtcgtcactggtggtttgtaaccactcgccgactaaattggcagcttactagctacgtgatggcgaaactacgttgctctctattgatgaacgggctttcaaaataatttgagaatataacgcaggtatgaagttgaaaaatgtgtcgtctgatgcccagttgaaaaggcaggtggcctcgataatgggtgttaagtatgtcacatgggaaaatttcaaatgacattttgacgagaataacaggaagacggaggagtagaaccaaattaacgagacataaaatggttacttatcccaatttgtttgttctaatgcactttctctttgatattaacgcgacaatttagttcattgcgacgttccaagtcttgagaacctgcgaaatcttagtttattcatcactatgcggttcataacttttacacttggacttctggggtcctcggtgactgcctacgccgctgctcttccaagaaccccaaacgaattcactgaggtcaaccctggcggtttcgaggatctggttgttaccaaggacaacaccctcaacggcacccgcactggagatgaacttattatccctcctccatccagcaacgctgattttgaatctattggtgtatccgctgtcgcagcatctttacctatgaagtttgtcaacaactatggtgctgacctcgttgcgtacgtgcaaggaaaggactcgagtggcgctgcagtcttcatcctctctgacggttccctcctgtaccccagctctggaggttcgaccacgcctgtgcaggtgtcctcaagtgttgtgattaaggttgctgccggccagactttgagcatgactattcccattgccatcagctcagctcgtgtttactttgcatcggctgccttgtactttggggttgtctccacgggaagtggtgacggtatcgtccagccatcccatgtcagctccacggatcccagcgcgggtatcaattggggattcgtggagctcaccctcaacacggacggaagtctctttgctaatattagctatgttgactttttgggccttccattgggaatagcactcagcgtcaagggagggggcacccaaacagcctatggcgtttccgcaggctctgttgctgctgtctgctctgcgctcaagacccaaggaaaccgtgatggttacccctgggccggtctttgccagaccaactctaacaacccggtccgcatcctatcgccatattcttactcggacatcgactcgagcggattcagcgcctattgggactcttatgtcaactcagtctggagcaagtacacatctcaagacttgattctaaacacccagacctcatacgggtcggttgcgtgccgcgtttcaggcagcaccttgacctgtgcccaggataaccgaagctatagtaagccgtctgctcgcgacatctggggctgcaacagcggtccattcgctatccagagcggcgacaatgccgtccatgtagccgttgttccccgtctttgcgccgctttcgtccgctccaccctgcttctctccggtggcaacatacagcccagcctaggtcagagttattattacaccgtcgatcctacaaactattacagcaaagctgtgcacgcccgtgaggtagatggcaaaggctatgcgttcccatacgacgatgtcaaccctgatggcaatgaaaatgcctcgggtacggtatcgcatgccactcctgatacgctcacggtatacgttggcagcccgccgtaagcttaagtgccgttttctaccttcatgttttgctggagaataggtagagaagggatagtaaaggattcattcatccagcacctgacaactatcaacacttcgcacatcttgtctatatttaccgctcaatatagggaaattattcattatgctgaatttaaacgtgatacttccttttaagttgtttccaagattcaagtatgaatctttcatttagcactgagaatctcatggtggcaaccatcacgcgtagcttagttttggtaggatactccctccagtccatgacaacaaaaagaggtcaatatcaggcctttcctattgaagacataagttcttccgtctttttaccccgacccggagttaagggtcggtatcaggggactaagagcgagtagtagtgaggagagattgattaccgcatttagaaggcccgccactgcgtcatatatttaaaagaaccgtcagatatcaaaccgagagcaaccgtcagatttatcttccaatccatctatctcaattgaagctcttccaactaatttgtataaaatgacgtcctatcttatcagcggctcttcccgtgggcttggcctagcgttggtggccgaattggcggcgaagccggcatctgaggtatccaaggttttcgctgctgtccgcacggaaaccaatgaggtaaagcaactcgctatagatcaccgcggacgggtcgaactcatttcaatggatgccaacttagaggactccatccgagccgcggttgcaaaggttgagcaatcacttggtgggcaaggcttagatgtgcttatcaacgtggcaggcatgtcaagcgtggcgatggggggcatcgagcaaatgtaagtgagctgggatgtccttaatgtgatgatctcatgctaagtttgttactgactcgttatacatcaagggatgacttaatgtccttgttcaacgtcaacgtaatgggcgcacaccaggtgacgcgtgcgtatttaccgctgctgaggaagggcaatgcgaagaagattgcaaacatgtaagataaggtatcctagaggaaagtgacatgttcacttgctaacatcaagcaagatcaacgaccgttgggtccattactatggcacctacatttagagaaattccgaccccagcatacaagatctcaaaagctgccctcaacatgcttacggttcaatatgcactttctttagaagatcaaggattcactaccatagccgtgtctccaggggttagttaatccttcttccaatttatggctattcatattgacaagtggaaaccagtggattaaaacacccatcggtggtgataacgctgacctcgacgtgggaactgccgctagagctaccctcgatgtcattgttcgatcaggtccagacttgaacggaaagttcttgaatattcacgtgcccggatgggaaaattccccgggcctaaatcaatacgaaggtggccagccagcttggtagactgaaaaattactgcttaatcacgcccaggacggagaacgttcgaaatctatctgtatctacatttatggcttgctcggtgcagatagacgtactttaccccactgagggattgattgatcaagtaaacttcctaaagaataaggggcatcaaactaataacacattgaaatacagttattgcctagagaaaacctcactagccacggtaccctgcgagccgggaccaaaagttagttccgtaaaatgattgtctttaagtgaaaacgcctgacaggaccaagctgccacattgtactggcacaaattgactatttaacacactccatctgatatcgagtcggggcccacttgttatcttggccgggttagatgaattagctatttttcactatctgtagtaaaagacatccttttcaccccttcttattttcacttttgaaatcccctcttatgaaagatgcgtcttctagcagcgttacgacagctacaataggtcaattgaccagctgtatacgtgaactattggatcaattgaggctacacacaaaactcaaaacctccttttcatagctgttatggaaggttgttagattttggtgtggttggcagtctgcatttcaagctctcaaagagccgtggtgttgttcgtttttcccccaacgcaatatgataaaagagagggcttccccagcttgggttcgagccagggacctcggacggcgagcttgcgtcctatctgctggcctcatcgagggatatagcggcgttaaacaacaacaaacgaacaagcaaaccaaataaacaagctgctcccattctcgacgcgtgacatgattttccctggaaagagtgaacttcattgccagtttctggagcttctcaaagcaatctttcagttcacgatgagattgcttaagctgggcgacttcattttttaattccaccaaccttgggtcatcgccatcatctttattcgagtttttcaagtcattcacatccctgttgatgagttgttccatcagttcttgccgctctgtcaatttcctcagtatgcctcgaagagactcagggtcctcatgctgtcttcgtgagtatgcttctgccccgttaatcaggttatttacttcctttggtgaaagatagaaccgacatcgctccaaatccggtggactaagcgcttgcagaagctctctagcgcccacggcggccgccaacgacgcataatcatgccaagagtcattcttgtgtccatccgagtagtcggagatgccccgaatcgagaatgggttgggaatatacgtcatgcctactgcttctatttcgaagcagatacagcctgtgtcgcgggaaatctcatcccttttgattgcattcttcatcacctagtcagccgacgcgatgattccctggtgcagcactactctttggaaagggacttgcaggcggcgcctaatcaagtaaggagacgatgacgcagcgtgaatactacaatcgcagccgtcttcatgtagatagccacgcgcgtataagcgatctttattcggtcgagcagagtctgcacgcctgtatacgtcaaatcgctttttggcgtcttcaatttccttctcaaggctcagaccatctctgacgtttttcttcaagagatgtgaaaatccacatgagttctcgcgggggnggttgattgagtctccagtatattggaatccatcttgtcgttctttgccgaatctgtaatggattatcttggtccctaaaacgatgtctcccagtcgaacatcatgatcttttgttttgacactaccgcctattcctactaggagaaccagacgaatccagggaaaggtacttctcatcattgaagcggtctaaagaacttcaatagagcctgaactacctgggacagggactaacgatgcggccaaggatgtattgtccattgtcattccgggcatgagtaattcctgtatcggtatataattcgtctaaaagctttttagcggcgaagtattctttttttgggcggagatccatcctactgtgaatgaactctccgaaggagccctggttgttggtagtgacatcgtaatagagctaatgtctcgtcagcaaaagagtacaatagacggagagaatgatgtggcgttttgcgaagggtggaaaatggtacaatatagacgagtggaaggacttggccctcactgtattatctttcattatattaaaggtttaaaagctttttttattaacgctatcttccgaaccctggtttcttccatatcttttcctcccttcttattatacagccctacttgttcttcttattaacagtattctactgaaatgattctgccttagctataaggaattagaactattctaatccctgactccttaacgccgagatagctttagtattaagtttatccttgggtatacgcctaaggatatcctgcctaaagttatataggtctttgatctgctccttagagaggctgttaagcttgatttcatctagcctgttaaccttattgctttttatagcctttataaagctggcaagcttcgggttactagtactaaccttaggcttaataatacttaggtagataatctgattacctttaagaaaaggtactaggatattattctttattataatatagcgaatactgcggatatattagtatcagtactctagctaaggggctactggtacttactgggttagttagtatattcgcacttagttgaagtctgtggattagtatataagaagccaggtaaagagagcagctttaatagttatttaatacgcagctcgtcctgatagcaagcgagttatcggtataaaggtttatagaactttctgctgtataactgcagccttgggctagtaaagcttttttttaacctttcgtattcattgtgttgagttgttgggtctgacttcttcttttgttttaactttctatcaaaactctctccggtggaaggactttgagtttaaccttggcaatgataaccccattcagccttacacttttgtgccgaaatggctcattaagagctgctgcatgctgacgacgtcgaacggaccactcagaagtgaaggtgtgcaactaccatccgcgatagatgggtgacgtggctgtaccgtaaggcgcgtggtcacccccaaggcagatccagactggagtgaggtgtggcgtaatagtagctgagatgaaaagagctgtaagcgcaacgttgctttctatgcaatgagtctgccttaatccatccagttttcatgcacatcatactgctttattctagctgacaaacacagttaatctgttcattgggaactgaaatttatgagtccaggcctttatttcatcctgcaacctcgggccttttcatgtcaggcccgaagaataaacgacaacggtttgttcgaagcggctttcgtaacctttatgaactctcagataatgtgaggattgaagagaaggtctgtcgcttcgccagaacatctgcaactgtacttaatcatagttttagtggcgtgccatttattttccttcatcctaatccagcctaacgaaaatctagcagcacggcatcaagaatttgcactctgaaacaacctaaactcactctcccgttgtagtcatgctaagttcgggtctggcaccttctattgttgtttttcgctacactcgagctgtctcccatatgggtttgggaggaccttgtctcccctatcttactctcaatgattttcccctcgactagtttctttttcttgaattgctgggcacacccgccgaagtaaacttatatctttgctaaccttggagagccaactaagagatggtagggccattaatttggctatctagcgtcgctgttgcctaatcttttgatgatttcgtgaacgccagcaaacttaagttcctctaatgtttctgtccaaacctgctccatagtttgagtctcctgagatgagtagatcaatggcgccatcctaaacatcgcatgcaatattagcgctcgggtcctctcacagccctttgatatatgatacttacggctgtaactttccatcttcaatataaattccatgtgactttggcccgtgattacaagctgcgtctgtaagggagcgtgcccccttgctaggggaataaccaaacacacgaaaaaatataccgatcataaagccagagaatgtgcccgcaaagtctcgcatgagtgatgatccataacacatgcctgggttgcacatgttgataacaactgcagatggggggacgtgtttaaccagctccgtgacgaagaactgccccagtaacttggaggtccagtagcgggttccatattcgccctggttaaacgtctccggcttatcaaatgtgggcagcaacggtgtcgtctctctttctttgaatttagaccaggaagctgtttcggagctgacgatgaccaatttccctggccgatccgacggattgcgctctttgatgacagggagcatgagtatggagaggagggcggaagacaaatgattgatctgcactgactcctcgtggcctgtcatggggtttagctcaaacctccccttggatactccggcattgtgaacaaaaatgtccaggcggtccagagtttcgcactgtttgacaaaggactgaatcgaaccatagcgagaaagatctactttccacacatcgatgtgatgctcgctgagagatcttccctcgaggaggagtttccgagctatctccccactcggaacatttcgcaccgcaatgataagcctcgataacccaagatcaagaaattggcgggcgcactctaggccgattcctgtatttgagcctgtgacgacggcggtttgcccttggaggttcacgttcgctttgagagtaactggagctccaccaaatagctgtcgtttgataaacgcagaaggtgaagctctttcttcaggcgtaatgtcgaaccgagtggcaggcatgctgatgataggcgtggatcgattgcaaccggtcttggggttggtacacacaggcgaagagaagaatgatgatattccttttttttttcgaaatctcaaccacggtacgatcttcataaacttttataacgattttattcgcactatcttaccagatcgcgtagcgctgttggttctactacggatcggggatatcggctgataatgaggagctggtcacaaaggtctgtaccaaataggaaacatctttcgtcttggcatcgcattttggattatatatagcgtgatgccgttggctgtattccgaattggggaaatacttactaaatatccgatccttcttaagatgcagacagctgctgaagttcggattttataccggagcttattcattgtattgagatgtcgagctttggcatcttccattgctgtttttatttttatactcaatttctcttacgtataccggaggcttccaaattgacgaagtgctcatctcgcttcacgaaaaaaatcgggaagtccgaagagtccgttaactcccccaagtcacatcactgtagtgccctcaaatatccgccacagaacaaatgtaagtctatctgggggaagatgaatgcgtaaccgcattgaaacttcccttggcagcgcgttcagtcgtgagtgcagatatttgaacgtcatgcggacctattccagttaaaatatgatggtagtaaatctttaacaagcctgggtcatggcagcattcgtttttcatcaagctgtcgtggctgtggttcattgctatcctgttgtgactcatgtgagattttaatcgatcatcatttcattcggcccccgacatagcaaaatcgactgaatttaaatacaagttacaattgccacccatcgcacctctggccaacttctcatcgttgtctaaactctagtttttatcgtcatctaagtcttcgaaaccgaatcaagggccaagcctgaaacgtccgaattttcgcacttcgaagtattgtcgggtccatgatgcggtttcttttgctatgccttgcttcatactgcaacttgcacaacaacacttagccgggcaaccatatttgtacaccgagttttaagaccccatcgatgcacttaagtttaggacgtccgaggttatgattagcttgttttcgaccatcattttcatatgtataaccaatttagaagactgtgacttgctgaacatgctcgaataaacagagcctttctagctttttgttccagggaaatatgactgtcacatgaaaaacatggcaatgatagcacaatcgttacgcgctatctcactgatgcatatctaattttacaaatcggtgattttaatccaaagctaggcggcgaagacttcaatagcttaacctcaataaagaccgagtagggtcagaaagattatgcgacctactttagaacgaaggtattgagtatttcggggttagacggcaactgaacatgatgtcacggctctcgtctagccctcaattactggattttattctttcctcgtaacgccattagcaaaagagtcaaaacatcattcatagcgttgagataattgatccggagacgtagattaattatgtatctagatcgttctaagtataaatgacaaggctaagggctgtgaacgttggtgcgagatcgctcaacgagagtcgcagtagttacggcaagacaacgaataaccatcaaacatataccctgatttttgaaagtatatccttacatgttgtgcagccataatgatttccaatagtaacccaagcactgactcgagatataaatgggatcatgtagtgatctatctatagctacgtcccttataacacgtttatatagcatgcccacctctaacaacaatcgcaagtccagttgtttgaggcatgatgaagttaattttcattcaatgacaacctagcttctcctcttttttttaatctcccgtcagtgtaatccagcacagctacgcttgatctcgtagtggatcgcgcaagatgattctaattctcgacaagagaccatctctaccctcttttccaacgtcaaaagaaacattttgatagtctgtgaactgcctagagggggatcaatacattcatagttgaaatatttcattcgttcttcagccgtaaatggtcaaaatgaaagctacacattcgaagcggctaagggcgggggaagatatgagaggattgaagcaacttgagcgatccatgccaaaactgcaacaagggttacggtgggccaattagataagccgtagggttgcgtcacggacatctctggcctgggtgctcaaatgagagctctttgaaagagattccgtagcccggtgaactggccgttcatacttatcatcaattgtcatcgattaccactcttaaatgcctcagattcttgcttctagacacaaaaagcccggggaatcacccaatttctagggtgagaattgcatcaccggcacattgatccgaagacggctggggtcctgaacctgtctggcgggaggcttgtcggatatgtcggcaactcccaccataaggtcctccaaaagcactcgaaacaaaccgtatacagctctagcctaatggcatcagcaatctacatgaattaatcgcacatgtcaccttccaaaaaaggctctcgcaatcgcccaaccttccgggctgcagcgatcatcgaccattacgtctaaacccgtagaacttttggagattattggaagctgtgcctgatgcgatattccccaacttctcattatttaaatcagaatgatggtagttcttgtagctcaagattcttcgcttttccttacgtatgtgtctgcgtatgaaatttggcagcatggtccgattgatttacctcgtttctgctctcgcagcacatgctgccaatgcggtacctacccatgatcaacgctcgtaccagataaaggaaacacatatcgtcccaaggaagtggcagaagattgagcgcgctccctcgagccatatcattgaccttcagattggagtgagacagggcaactttgaagagctggagaagcgtctcaacgaaggtgagaatcccacaacctccattgcaaccaatttttagtgatggtgtgattaatatcttatagtctcccacccggatcatgacaactacggcaagcatctcacccaagacgatgtgaacgagcttatcaagcctactgaggattcgctcaagcttgttctagactggcttaaagagaacaatgttactccttcaggctatagcgctgctaaagattggataacggtatctatcccagtcagctctgttgagaaactgctcaatacggagtaccacacattcgagcatgacaacggtaaccgcgtctaccgaacatcccagtggtctcttccaatccatttacatgagcatattgagactatccagcctacaacttctttcttccgcgcccacgctcagagttttgaccatattgtcgagagttccgaggcaattgattctctcacatcaacatacagccttaacgggggagatgagatcagcaagctctgcaacatcagctctgtaactccgcaatgcttcgaggtcctgtacaagacgaaaggctacaaggcaaagtcaactacgaagaattcagtcggctttgccaactacctgaaagagcatcctatccgttctgatttaggattgttcctgtccaaattccgtccctttgctacagctgtcgccaagactttcaaacagttcgttatcgcagacggtccaggtgatggccctcttacacctgaggatctcgaggaagcccgctgcaaagaggcgaacttagatgtgcaagctattgccggaattaactgggataccccaatcattagctactctacgggtgggaggtaacaactttcgtctccttgtttgtcagcgatcattgctaattctgatgtacatatagccctcctttcaatcccagtgcctctactccagataacaccaatgagccatacctggcttgggtaaactggctcctcgaccagaggtcaatccctaacgtcatttcgacttcctacggagatgatgaacagagtgtcccccgctcatatgcagagcgtgtgtgcaagcaatttgctgccgtgggcgctcgaggcacttcgctgcttttctctagcggagacaatggtgttggatcattcgctccggaagaatgcattagcaatgatggcaagaatacgaccaaattcctgccgtcattcccagcctcggtaagttgaatttaagcttctcgtagctttcctaaatgctgaacgccaaaacaaaaactaatatcaaatagtgtccctgggtcaccacggtaggcgccacaaaggagttctctccggaagttgtagcctggcgcccagagttcacggactccaatggagtgcaccatggcaactggtcttccggtagtggattcagcaactacttctcggccccagactaccaaaagaaggaggtgacaacctatattaagaacttgaagggcaagtatgatggactatacaacaaagcaggaagaggatacccggatatctcggcccagggattttactttgcctatttttggaacggcactgagggtgttatcagtggcacgagcgccagcacgccacttaccgccggtatcatttctctcgtcaatgacgccctcatcgcatctggaaagcctgttttgggattcctcaacccttggctatacgcaaggggctacaaggggctaaacgatattaccatcggtaccccatatggatgtggtactgacggcttctctgcaactgaaggttgggatccggttacagggctgggaacacccaacttccccgagcttgttaagttggctggctgtgagatttagcgctatggcatgtgagagtcgttcctttatatagaattactccatcttgatataattttgatatgattctcgatctcgtcttgagcctttgagtaccttggataaggcagatccacatccggcagctgcgctttttctgggatcaaaccagcctcctacctagaaatttcgaagtccaaactgcctataacacctggcgctgatcgaatctgaaatcgccaatagctttatgtgagaaataaatacacaaatcggaacaaatgatagtgacggaattttatattttcctgagtactgacttatcctccctcttcataaggtcttagtgaggcatctagcgcggttgggccgtctctgcgttggtatcccaagtcaaactgattgcttttcatagtttatattttttctttcagatcacttttattttcattattttcaaggggaagacagtaaatcacaggctggtattgcctgccacgcacaatatgatggccataactctttagatatggttttctatatagattctgagcttttggtgtttattgtattaggtcaatctttttggctcaatcaagtgacatataagcattatctgtccttgtggggtgagtcgatatctgaatgaaggttcaacttcctcttctaataagtaaaacccaacgccgaacacaagtccctataactgcctctgggtatataaactcaaggctatttataggtacaaagtagctagtaggcaaacttcctatggatattttttacagagagtggtaaagctaggaccaagttagagtatagaaactgcaggataggaactctagatatttaagatagtctgttgagctttatcagtaagcttattagactctatactatttatactaataaagctcagttaatttactgtacagaataagtatatattcatagatctatcctttatccctgccggtctgtaactataagcctcagagactctcgttaccgcttgtacccggattccctggtatagggtaggcttatcgcgagtggggttgagtgatctgatgctcgttgtgattttggcgctactgcgtgacaatattatacaaggattggttctagataaagttagtgattggctcaagagcaactccaaaacatagccaatgacggactagccgatgaatgtattgtgtggggggccttatcccaactcatcactgataaagtagcacgacagctcttgacaagggttgcctcacttttcatgcaaaccggctgcctgagcacaccactcagccgcaagagttgacgtgtagtggtgtctcagccgtagtaggtacctaggtagtgtaagctagacgcccgcttactgttacatccctacccttgcatgcatatacggtcggctgtcctggccagccatatcttctgccactcactctcattattcggtaaccagctttatgctcatcttattgtattcacaaatgtgcaaatctgttgccgaacgaggctgccgcatgccaagcatgcgaaccaggaccctaagaccagaatgcatgtaggcaaccttaatcttacagggttgcaggacctaatcactgcccacctttctctcctctcttttctcgtcaggtcagatcacacaactcatattagagttttttcgagcacaccgacccgaccgttttgtgccgccgtccctccatgaaacgtctaatactatggtcagtctaggccggctagttcaggaactcaggcctttcaatacacaggacggattcgtcagcgcggaagatggtatttggtactgtagctgcgggagttgcgcaatatacacctacgcggtactactagacagccataaccggcctatggaaggaatgggtatgctgcctgctctttgatcttataattcttgcctaggaaaagatcttcgttgaccatcattacccgcagggagaatacaagccacatgttcaacgcagcggtgcaacttcaaagcttgctggcgcgctcaagatttccagaacgtggtcaatgagttcataggatgcaacgaagcaaattcacgacaggatactgtgatgagggcaaacatgatcaccggctacgaaaattttacgggaagtaagtaatgaaactaagctttgttcaaagcattcatgctcgttatttcatgatggatctaaatctcacacaactgtgtctagtttattcgccgaatgttcatgtgcactatcaacccgtctcgttcctatttttgcaggagttcagctcgcccgttgcgcagatgattcccttcaaccttattcaaacgcacagcgggccgattccacaagaacttctgtttggatatctacttcaacacagcaacccggtttctaccgatttacatggccaacgggcctggccctggctttggccctgggccagggctaacaatctgcgggcatagtgtcttgacactctcatctcgccaactccgagagcagcaagactgcgaagaaacctcccgtcacctcgaccgacctcgcgaggcgagcatactgccccacagctagtggctgctccgccatctttatcgacccttctgtgattttgactggtataacatctactatccatccgtcttgagcaggaataacggcgggccgatcgaacttcatggctgacactcggttttgggagggagaaggctagttgcaagatggactcaattagtattccgatgtgatccttgagttttcgatatagtagaaccaggggacagtgtacctcagtatttctcatgatctccttgacgagcgtgctgcaaatggttgccaactgtgcggtgttttggcaaatatggaaattgtcgacggattggaagttggcatcctctgtttcaagccaagcggcgacctttccaatctcgctatcagcaagaggtaaggaatggatcgttaacttctcactgttgctttccatttcttctaggtctgcaacgaggcagcataagaaatgttgcaatagagggcaacgtcgacgtaaagtggcttgcgtagtggatgtgtgaggaaagagtctgcgtggatccatgcttgccaactggcattctggcgctacatgtacggtccgtaagcccgcatcctggagcgagacacgcagcagccacctgcgtttttgggggtcggcttacggtttcagtcatgcagcccaaggctgcccaaaggttcctgtatggctggaacggggttttaggtcgcaggcatccagcctaagcaacccaagcagcccaccatctttgggtggcgaggaggcagctaacggtttcgtaaatgtagcccaaggagctcgaagctgcctaactacgtctgatgattaggtacttcatatattaggcgatacctccagaatgaggccacgatgtaatattacatgataatgcatgacatagcccggattttgcagcaatgcctcaccctgcgcggttgcctaacatgtgaagaccgaaaattaacataacgcgtgaggctacgtttatatattagtcagtgccatttggctaaatacggcttcttcctgacgaggcggatgaggccttggacttggtagacgatatagaataaaaacgtttctaaaatatctacggcattccttgctgcaattcctaatgcccctgtccatctgggcttgcaactatttcttacaatacagagagtcggtgtgtgacaagccgctacttgagccaatggatgcattaggtgtggcggctacttcgtttcagctcgtccaaatcctgctccagcttcgcacgtgcttaaaacaccaaccccgcaaactcatgtcctgggacgaggagctgtcctgtcttgatagaacaattacctctgtctgggagaacccaaagctgcacaccaaactagtcaagaccatcctggagagggtagtggctaaagctaaggcactgaagaacctcctcgaacagctctctccggtacatcagaagaagaaattcgacattcaaaagaatattcaaaagatcaccaataccctgaccgcaaagtcgaacgagtcccgaatcctaaagtattttgccgatctggagcgtgacaagataacattaatgcttgccattagcacaatcaactcgcccgacctcgacaaacccgaagataattccaaatcgagcagaaaatcccggaaagagagaaaagatatggagccaaacgagtctgaacacctcttcgcggagcacaatcctttgaacgaaattctgcatcaggtaagaagcctctccacgccatgtcccttcgttcactgtttctgacgagactacttagtttacgagcagccgtcagcaggttcagcaactacagctaaccgcaacgtcgatagctagtaacccgacttcaaccggtgctatcgatccacgaggtaactctgataccaatgtgaaaaacgttatctccggaaatgtggcagagggaaacggaagttctctggcaatcagttcccggtatggtggaattattgaaagaaacgaatccaaggggaatcggagattggacggtattcacgaggaagaagtaatgaaaacatacatcaccgaagttcaagcaggcccgatggagatagacgaaaaggaggaagtgatggcggaaatgcacctcccttgtggcacgccttcagatattgttgatgcaatggaagtggacgaggagggggaaaattaggcagatagctcataggacgaaagagcatcacagcactaaaatggatagactcccgaacacaagactacttcgtccttcatcctggcacaagaatagcacaagatcgacataagtgagagaggacgagcagcgtgtttctaaccaacgtgtctgagcaaatactacaagatggagcgatcccattcgtgttattcctgacaaaaatccttttctcgtccacaggcaaataaaggaagaaggaaaccgagatcaaatcctaggtgaacagcctgcgatcgacatcttaaagtcatcacggcacgtctctcttgatgaggccccacagcttgccacagtgttctttgtttcggtcgccgttatcatccaagcaattgccttgaagtactattggaaaagcatgcggtattggtagaagtttatatcacacggcattttcgggggaatcgtcggtctatgtaattgaaacgtaaacgagaaacagacgatgcaccttttcgaccttgagcgagcctagatagttgtcaatagcatgcgtcagctaacaaagttggtagcactggtgacaagctgagagatttggctgggttagtgtcgacttgcaactctgtcgcacaaagccagatctttagacatcggctctccaataccattaggcctttccctagtagttaaattaaagcctagccatcgggatggggtagatttaattcaagagccacagaatatttttaccaagggcaccggaagggactatagccgtataacagattgtatggaccccggccgcaggcctcagactttgttgatgggcgcggtatcgccaacccgttgtttaggctgtcttgcgaagtaatcgggaattgtgtttcttgttgcaccttgcgtcgttcctcacggctgtggtgcaaaatatttgctataccagataagaatgggtttttcgagaatcactggtcggagatgaaggttttgaattcttgatggttgcaagagtccatgtgtagtttcgaaggaggaaccggaatcgccttgtttgctgtgttcagacgggtggctaagcgcattgcttatttcttgggtagggtggcataagcacacattccgcgtgacactaggcaaagcacaccatgtgacttgaagagatgcaatactacacaaactaatgcgttggcactaatagcatgacgccttccaagcgccttggttacccgcctcatgctattggctggtagttcccatcacagttgcgccccgaaccttggcctcttccagtgatgtaattaagtaatggttcaaacccggttttctgggaagtccaaagtcccgtatcttgtaccaggattgggtcattactcagttgctctgagcgaggtgggccttgaagcgcgggataatgatgaccctgatactcttggagacccgaatgagcctccgggggaaacaaggtggaaatacatagaagaagagtacaagggcattttacaggctgactactcggtcctcagcggccgcgtctaggcgtaactttccaattccctgctgatgaccagctcttccaagacaagatcgggagatatctaatcgcttgggagaaagtcttggcacaacagacaatacgccacggaataattccagtactaagacgactacactgtgagtagtcttatcttgtacccggattaaagtgtggccgggttctgacatcatcttactcaccagccaatcagcctctccacactcttgacttgggactacttgctgatcggagtacgagctaagctttcgtaagttgccgatgtctcgaaggccaaacgcatgttcacatcttgccatgatgagagctcccttcgccctcgtcgcctacaacagaaaaatatccagttcagttgagcatatgccactcacagaactccagggaatcccaacgccgtataagtgttctttaactccaaaaccactggccatgatcatgggatctgaacatctgcgaggtagtacgtgagcagcgtatgcataataggaccctcataattttaatctaggtacatcacttgcaccagggcttggcgtttcctttcccagtctgtgcaaattcaaaacttccacattgctcatagatctcagctccaccaagttcaagtgtctacattgtccaaattgtccacgtccctctaggcgcggaggaagctagtcccttggagcctcagacggtggacaatgcaaaatcagtaccccaagaggatccatcccaattttcaacttaagcctaactttaactttaatggcagccagacgcagaggcaatgttgcactcggacatctcgccgttggccggatttgcattgataatgccatttggggacggactccgggctctgccaagccaagctatgtcgcggtctcagatatcccagcttccagttctagaattcaggtgcttcatattagttgcacctgtctattaagacccacacacgatgtttaggtccagacaacgtgggctgatggagtaaaggagtggcaagttccaaaatgacgcagcgattctcacggaatacagaaatagttgaaatagggaagttgataatgaagacccgtatagatgctttgacccctgtcatagaaatactatatgtaaagacgttgccctcacagttcacgaagatgtatctggaacaaccagcctttccgaccacattacccaacaccgctagtcacaatggtgtccgtacgctctctcgcagcctccattctgcctcttgcctccatggcagcagctctccctcttgaagatggaggcgtcagcatcaacattgttggtggcacaaccgccaccatctccgagttcccctacattgtcagtctaactgagggcggctcccacttctgtggcggtgtcttgttgaacgccaacaccgtcttgactgcgggacactgctccgagggcgtgcgcgcttctgccgtcaaggtccgcgccggaactgctgtaagccaatcccattcacgttctagttcttcgacctctttctgacatcaatttcccttgcagacctgggcttccggtggtaagcaagttgcagtctcctccatcaagatccactctagctataccgtcaaggacgatatcccctacaacgacattgcgatctggaagctgtcatcgaccatcgctgagagctctaccatcaaatacgccgcgctcccagctcagggctctgatccctctgctggcacctctgtcactgttgctggctggtacgttatggacacttgagaatctgctctatgttaagtccacaacaagctaatatcttgtcgttttctttaaatacaggggccttactaccgaaaccggcaccagcgttgtctcggcgctgcgcaaggtcaccgtctccgtcgtctcccgcgctacctgccgctcccagtacggcacctcgtccatctctgatgtcatgtggtgcgctggtgccactgctggcggtaaggatgcctgcagcggcgacagcggtggccccattgtcaagtcctctggaacccttctcggtattgtctcttgggttaacggatgtgctaggaagggctatgctggtgtctacacgcgggttggcagctttattgactggatcaacaccaacaaggcttagataaccatgtaattgttagcagcctgcaaaagagtatttaatttagacaatgaacttaattaaccatctaaatcaagtgattgcttggtataaatacacttggtccgaatctttgccttatctccagtacttatatgagctaaaaactctcaaaactaacattaaaaggataagtacgccgaccgggatacaaatgtattgaataaggatggtgttcttaaaagggcacccatctgagtacgaagaaaatccggaacaactgcatcccaattctcaacaacggtgttttggagccctgatggctgtccaacaaggaatagcatcaatattgcttcatttcggaatgatacaatccgcccctgttctggttccaggtttcaatgtctgagtatgcggtttgacaggaaaaagtcccccacttggttttggacgtggtcgaaggtggcgtagcggcagcactcgctctccaaatggttgaaaagagcggcaatggtcgtaaacggtcggcggcatctgtggttcgggcagtgatagaggacctgctggtctgaatgagacagatcagacaaatattagctgaaaaacctctcctctgggcttggaagagagtgctttgcttacgccttggggagttgacatgctgcgaaagggcatagagactgttgaattcatggcagcagagattgcactggtacgcgcgtccgttccagcatgtgtcgccaacttcatagtggaccgtgcctttccatccaatgagtttcttcgtgatgactccgtacggatctttgtcccggacaaatcggtaggtctcatctcggttcaatccgggcgctcgagggcaacgacctgactccagatgaccagctactgctgcggcgtacgtgtagcgtcggtcgcagaaggggcagctggcttgtttcccgcgatgacggaccgatctgaggtgctaaaatgacgcgagatggagaagtcagcctgccgttgagcaacatcactgcaccactaacttggtcgacctaccgtcttgatcgattggaggcttgggaaagaccggttgcactctcggcagtagttgtggaaggatacttcgtggtcatggaggccttcggctgatggaaaggttcttgcgcagcgtctacaatcgctgggccagtggttgaatttctggaggtgacgctgatgttctctccggcttgggcaaatggcgccgcacacttggcatttgaaaccacgttgacgcatgctggaggcggaggcaagcaggcaatcttgcttgaggagggtgaagtggcagtttcagaagtgagaagagggagaggaagaggaagaggacgaaaagagaggcttctgcctgaggcagtcctaagaaacgggagcaaagagggaaggaaggaaccacacacaccattccctcagcatgataaacaactcctacccaaagaataatcacttcaaggaagggaaaaataaatgaatcatagtatgtcaagtgcgtataaattccgtgctatcctacctccttttgtaggtactcctagcttatggtatgatagcgatggcgatggcttcactttggagggtattgaaccagcaaccaaggtgaggtagaagtacatttgctctaacagtagccttcctcccccaatacttatcgccgtcgcggtctcagatatcccaccttccagttcgggaactctggtactttgcattgatacagtcagtcaatggcggcattgatcaattgttggggaatatcaaagaacactcacacattgcgacaattggaacgtggacggaggattgagatactcgttttggcttcaccttgacggctactagacccagcaaccacgatgaggtacgagtatatctgctggggccgcccacccaccccccagtatattatttccgtactgggacggctccctaaaacaggaatcgctgtagttaaatcaaagaaagacaatgcaacgaacgaaaaaaaaaggaccgctgggcttccggggggaaaaaaaacaaaaaacccccagtcgccggaaagaagcgaacggaagggaggaaaaggggggagggcgggaaagcgagtggatggggggagaaacgagtgaactcaccaaagtaaacccccgatcgaggactcattcaacgtctccagcaacaggcccatctgaccaccaatccagcggcatgatcttgcaagaggtctgtgtaggcgaggctgctgtgaaaacgcatgtcgaaaactgactcagaatggttcagcgggaatgcgatgggcttgaggtgcgttcgatgcgtcaaccgtcggcagttgaaagccctccccagcggcgtcattccgataatgaaaccagaaccgagtccaccactatggcaaacaaagagtgtcaaaagtcccaaatccggccgcccctaaaaaggggcggtaagttgtcgaggcggggctccaggcctcatattccagagcaacgtgaaaaattgtcgacaacagtttacactgtttgtcttggcttcgcacccccattccaacaccttggttcgccaattggcgaacttgaccagaaggggctgataggaggctttggggacctctttctctaccgtttgcttaccatattgtctttccagatcgaacctagccatcgctgccatcagcctgttgacctgctatgcctcgtacatgagccaaaggcccacgactccgacgatgatggcgatgacgccgaggatgatggtggttgaatccgacattttcaaatgagtatcgatcgatgaagagagaagaaaactagaaccggatcatcagcccaagacgctgctttaatactccaggtctttgtttactttcgtgcactccgcttgcccagccaaagttactgtccgctcttaccctaccatgacatcttgtactctctcgtataattgaaccatcagtagtacctgacctattgagcaataaagtaatggtttaacagaagttacagcgcccaatttgataataagtacttgccactacctacttaatagaactaaacacctttacgatctgtcaggtggtaccatctcatccgttcttctcaaacttttgtgttaaaaacagaagcaaaaatgcgaacttcttctccaaggtttccgtgcgtcatgtcactgacgtatgaaacagtcacatcgtggccaaaacaacgaggtaaacaaaccacattcagctccaacgcaacgccaacacaactctcgtaggtttaagttatgcattgacattcagggaagtgccagccctccagatgacgtatctagatcctggactctgctgtgctgcgacttcttgaatgcatccgtcgtcgaaatactctcggagccaatatactctcgacaccatacttctacgctcgtggattcgaccttgaccccaaatctggtgttgcaatcatagcaactgccctcgaagaattttttaggctccctcattgcggcttgtgccacagtcacccagtcattaccatccccgacgggacaatattgatacgcaggagggttggaggacggtggttcgtaccgccgaccatcccttgccactttcatggaagcaacaaagctttttcgttccttttcgctgaacccacgccaccagcctggcgcacaaaagggttggtgcccgcaaatccatctctcgccgtaggggggtccttgcagcagactgaatccttcgggtacctcgaaggttaaagttcgatctatgtaaaaagaatcgccttctatcctcggcacgatccgttgatgggggtcccagcctctgatgctccaatgtttgtatttgatcttgactggctgcatgatcaggtgaaagaatgagcaccagtgttctttgctccactccggctccttgcataggcgacgatacttgagcacgaactggataaatcggtgatcgtagaacggagcaactggccagcccttctttttcgaatccatcaaatgagcccgtagcttggggcatttggttttcaggggatcacagggaccatagtgaggattgtagggaggtgtgctgtgcaatttatagcaaaggctacagacccatttagctggactgtttcgggccaaaatttccaagtactcaagtccttcggggctggcaaaaataaatatcgagtcaccacgaatggtgtggcatacctgtttcagcctcctggatgtcttggatacgacgaagagcatgaagcgcggcagccggcgaagaatcattgccagtatagtatcgggaagtttattcagtagatggcagtttggcggttgcaaaacatccttgggagtttgtgccggcacgggcgatttttgctttttcccgaagcacatggcaacatccctcaaatgcgtggtgcgaaggaatattcagttcaaggaaagaaagagctgtgacttgtggaagaaagaaggcgaaccaccggtccgtgccttgcctttatataggtatatgcctactaactaattcaggatatacttcagaggtgtctacgtagctagaaaggttcagatgaatcacgcttcgcgttgaaggttttggggcaacaatcacaaaactcaacaccaaactttacttaaaggcaacctagttcgttcatgttgccacatcaaaagtttagccattttcaattcgagtgttatcttttggttggagctacatttagtgatgagtgataggactgagttttatctgtaataaagtggatctagacacaacactggcatcaaatggcgacataggcaaataccgatacggaccacaaaaataaagtcacaagcttagagtatgagaacacagggaagttagttctgttattgcccttggcctgcctcgtgtttacatttacctttcgttggcaaactttagcaccattgcagctccctcaacccgtattcccaggttaccctatatccaatcgacattcaagaaactaggtacactgttggccaaaacaattcacaaaaggttttggaatatcggaaatagtctcaatggatcttatcagccatcatcttctggtgtaattgtctgctataattttctgctataattggaatgcatggtttggctgcatgcatgtcatgatcggttcatctgcaataaacgagctgcgcatacagtctgactaaacattaaccatatcgacaggagtccgtattattatacagcatttccatgctagtcgttcatttctcgctccccaccgcttgactaagtcggttacatcatgtctagattcttctatgctattctcgagcctctggcctccatcacagcacccggaaaggtgcccggttagctcaatcggtagagcgtgagactcttacgagttcacatctcaaggttgcgggttcgacccccgcatcgggctgttcctataatgaacgattgatcacttttttggcctttttggcttgtcgagaaagaatgtctacaattggcacgaaggattgttgactagccgagcctggctatttttcgaatattccatatgaaacatacaagttgtaatgctgagaattggagcgctgtgcaatgtttgctagtcgtgaggtcatcctcggcctgagaatgcgtcatggtgataggccaggtatgactcacggcaggagagcagcaaggcaaacagaagaggaccgtgtgtaccaggaggcatccgtccgaggcctccatcgtggagagcatgagaatgaggggaagaaccctgtgaaagggccccgagattccgtcactccggcattccgcgcacgaggagacgcaccccgcaaataagttcaagaatggcctatctttttccctatcttggaatggaggagtggaacagtcccaagccgcgtctccacaaagatgctggcattggctgcggaaccgcgtagctccatggcgagggagaagcgtttgaggggagaggatgggtgacgatgtatagccggggcgaggggcgaatgtacacaaacgcatgcgtcgatgaatgggtgaatgagtgagtgatcgatgaagatagatggtgatacatatgaagagagcttgagagatctaagaggaagacaatcgagaattttagcacttttgggaatagcggcatgcctgttatcacagcttgtgccatctcaagatccacccatctccatatcccaagctacctaccaagagccgtgggcttttatgcgaggtggggttgatgaggtcagtcgagagcttgcttccctcgacaatataaatctggctttccacgaacgtgcgggccgcacctgatcctctctctctctctctgtcactcactttcacccactctcataaccttgtgagctcgaaacacacaaagcacaatcaagatggcgcccgcagagaccgtcgccctcactgcccccaatggggtcaagatcgacctgccgaccgggctgttcatcaacaacgagttcgtcaagtccagcgccggtgccaagatcagcagcatcaatccaaggtgcgtcatcgtccatgtgacatcgcatggcgtcctgttgtgcgagcccagtaaaaacgggaaatgcaagggtagctaacgggcatgtctcaccttagtaacgagagtgaaatcacctcggtcgaggccgcatcgcccgacgacatcgacacagcagtcaaggcggcgcgcgcggcctttgagtcgccggaatggagagacctccccggcactgaccgcggggagctcctgtaccgcttcgccacgctcatcgacgagcacaaggagacgctcgccacgctcgaggcctgggacaacggcaaggcctactcagtggccctgaacgaggacgtcggcgaggttatcaagacgctcaagtactacgccggctgggccgacaagatccacgggcagaccatcccaaccacgccccagaagttcgcctacaccctcaagcagcccatcggcgtctgcggccagatcatcccgtggaacttccccctcgctatggccgcctggaagatcggcccggccatcgcctgcggcaacaccgtcgtcctcaagcccgccgagcagacgccgctgtccgcgctgtacctcgccaccctgatccccaaggccgggttcccgcccggcgtcatcaacatcgtcaacggctacggccgggacgcgggcgacgcgctcgtctcgcacccgggcgtggacaaggtggccttcacggggtcgaccctgacgggcaaggccgtgatgaaggcggcgagccagaccatgaagaccatcacactcgagacgggtggcaagtcgcccctcgtcgtcttcaaggacgccgacctcgagcaggccgtcaagtgggggcacctgggcatcatgtacaaccagggccaggtgtgcacggcgacgtcgcgcatcctggtgcacgaggacatccacgacgagtacctgcgcctgttcaaggaggaggtcctgaagaataaggtcggcgacccgttccacgacgacacgttccaggggccgcaggttaccaaggcgcagtacgagcgcgtgctggggtatatcgagacgggcaagtcagagggcgccaaactggagagtggcggcgtgccgcacaagaatgtcggcgacggcaagggattcttcatcgagcctactgtcttctctggcgtcaaggaggacatgcgcatcttccaggaggaggtatttgggccgtttgtgacgatcatcacgttcaagacagaggaggaggccatccgcgtggccaacaactcgtcatacgggctgggagctgccctcttcacaactgatgtagagagggcgcaccgtgtagcaggaagactggaggctggtatggtctgggtcaacagttccaatgattctgacttcagggtaccgtttggaggtgtcaagcagagcggtattggtcgagagctgggagaggccggtctggctgcgtacacccagatcaaggctgtacacattaacatggggaccaagctgtagcaggatagtcaatgatgaatgatattttgcgttgatttaatgagcaaagccgatttctgtaaccctgtatatcgattgatccaatgtcagttctgaagtgatgatcatcttggcaaagtcacacagactcgcttgtgtaaccatgagcccaatggccatgcaacgcagagacttggtgccagaagcagccatatcaagaacatcggtcgagagactatattgttaaaatctagactctctacctttatttattgattttaaacttttttttcatatcatttactttcttttttttacttttttttgtttttcattctgtgtgtggtttgttcacgactggcaggtgactggaagctgtacgtacagaaattaattgttgactatccctccacagttccccagtccaaacattaagaatcgcctaggaggattctctccagaattaattgctcatgaggctttagagcccaatatcaatcatggagcttctaaacgtggtgttgaccgaattcccgataaagaacgtcggcatcaccctcgccatccgcagcgacgaaacagccggcgcatgcttccaaagagcttggatccgctgacgagccgttgatttcttccgacggttgtgcaggtcaaggcccaatacgtggatcggtgtactaaccaactgggctgcagcaagcgaggcgaggttggctagctctgagtttccggatttggcagtgttcaaggctgggtttgcaagggacgaggcggataactgggcaaccagagggggcagctgaaacgaggtgaagcaggtcgtggcatcgcgagcggcaaacagtatgtacgagaaaagaggcaacgacgctttccctacggccctggccacataaccatccttgtataaacaaagccccgtcccgacagcagcggatacacagaagcgagtcgtcgagagtttagcagacgaggcggacatggtggcagggtcgtaggagtcgtcgatggtgcagaacgagttgaggaggttggctgtggcatacgtgccgaagtaaacaaggaagcatatgtggaaggccccaagcagtttcttgggcttcgagaggaaggacttgcaggaatctttgaacgagtcgccctttgcaacgcggtagtatatcatcctatcatcatcatggtcagttgctgtctttatttgctcatataccatccacaccacacgaatgtacttggattctacttggagtaagctcgacctacttacttgtcaatggcattcacccatggagcaacaagcgctgcggcacatgcggccgagaagaaatcagcagcaaagctccatgaggtgcattgctgctgcctatggatactttcaacttcagccattgtagctaactgacaatgagagatgagtcaagagaaggtgtttgaaagaatagaacattctgaccttcagctagtgacagactcccgtggtcatataataggagtcacatcgagggtacaggctgcttatcccctgccccctccacctccggtttgcaatgactattctccccggaccccaagaagtgactaacattcagtcgagataagacaatgaatccgtggggttccgatatacttccccaatatggcgtaaacgcccgcaaaattccgtgcctttcatgccctattacgttgctgcagcgtctgattgggaggtcccaacaaggtggcttagaaccatgcagcttgggtacgagtacgactcgctcaacgctttgccagcggtccatgctaagccgaacgacaaggctgtattagctgcagtctagactgtgttagccactgaaagttcaccattgatttgatggcccaagatctgtcctagatccagttagtgcttccccactgcgctgatgcacgttggggcgcctatgctaacccgccggttgccggcttggaatgtgttgaggggtgtcatggtgctatcctatttcgagattgcgagtagcaagtattcggcgaaattcccgttgggatagctgggtaaagctaatgcatcaggatgaattgatctgtattctgaatacctgcccctgataagcggtgggatgagacatgaaacgggtcgttccgcttggtcgttcaacaaaaaggcgtgatagccaagttatgattcattcataattgcgtatggtatgcataagcatacttgtgaaaccctgataagaaagattgctgtgatgaggacaccaccatgtctggtcagctacttagattgccggtcagagcaccatgtcaacgcatctgaaatcgaggatctgtgacctttgaaactggaaatcggaacctatggcctattggagagattgtattaattttcatatgaaagattctccgtatccaagctaatattacagtctatattcccccgcttcgttgtgcgacttctgcatctatagcctcgagtgcggacttttggcttctcctcaattgagcgacacatatctttgatggaatgcttttgacaaaatcaaaccaaccgcttctaaactctcctagactcgcccaccgacttcaacgttagcaaatgagagctccttcattgtctctttccatagccggcgagtgacctccgctgatttgggcgagtacacaaatggtcccatactatgtccatcacattagcaaatgtcattgtagaaggaagccagctaactgattccggggcggaagaagcgctgggttgaacttacggtctaatcttgttcccatcgatggcttggccatgcgacttttccccttgcttcagggcggcattcatcacgacgtacgcaccgactgcgggcttgcggcccaagaggccaaagtagagcgccatagcagccctatatgcgatcccttccccttcaacatccctgcttagccctgacccgtggcaaaggccggggttggccgcgttgattatcacggccgatggcgagacgtgtgttgctaattcagccaggaaaagctgccctagtagctttgaagtgccgtagcgttcaaacgcatcccacttggcatctcggttatcaagggtagccaggagcgggtccccatcctgctcaacgaatttagtcataccagacatgtcggaggacacgatggtcaatcgccctggaaggttggccgcccgcttcttggattcgagggtgggtagaaggaggagtgttaggagcacagtggatagatagttggtctggatatcctcctcgtggcctgtcagctcgctgatgatcatattcttcctgaaaatcccagcgttgagaactgcaatgtcgagattgttgagctggcttgccctctcagcgaacctagtgatcgtggcataatctagcatatccagtttccacacctcgatagagccgggcgttaacttgtgcttggcctccagtatctttgccgcagattttcccttttcctcattccgggcgcctatgatgagcttgctgactttcagagtgaggagttgatcggcaacctcgaaaccaatgccctggttagccccagtcacaattgctacctttcccgtcaggtcgacatcggataccggtcggggtgattcgaatagctggcgccgaagccagtggggaaatgatgcatatttctgggggctgcagtcgaacagttccatttttactctcatgaggacctggagcaagtcttagatttgtagagaggtagagggagatttgtccgatctgtaggtcaacgaggatgattgcttccttcatgttagaaatgagagttcctcgttccttatatatgtaaaattgataagcatccatcatcctctaatatataacttctcacatcatattgggctccagaaaccatatctgctctaattttgcttgactctcaaattcataatctcaaatgcggtggagccaacttcatggtggcactgatgacagtttcaccatccttggttagaccgtaggaggagcaatgagacgttgatgacagaatttccattcctggtcaagttcatgcaagcacaagccacctaccactgctccacttctatctcttatatgcccagcaagtttccatttctctaggctgctgaccttttctccctttcaagctttgatgcatccaacacgaagaagtcggaccaaaattgatcccgaagtttaaagtgccggtgaccatttttacctaaaagaaccaaacggaaccacttcttctaacctcgaccatgtcagcggacgaagccactcaagcaaagcagcggaggaagctccagaaccgggtgaatcaaagagcccggagtaagttgcgacgtatccattgcccacgtaacacagctaactcgcccaggatcccgtctaaaaggagatgacgacaagcctcgccgtccattcgaagtcacgcgctggcgccttgatgacgaaagagccgtatctggcgtccgaagcggccgacatactaatcctgcaactcgacacgatgatgccccaaaacagaaaggctggtctcttgaaacctgccgcgtcccgccccttagtgcacaagatgccgcgttggtagagagagagcccttgctgaggctagccctaccgtatcttgcccggaaaacatcgccattgcaggatcatcttctacaccttatccacttcaacgttctgcgtgccgtcttcagactgaaattcatcctcgcgacctcgacggcattctgcatcggaagaaacacaccgggaactgagcctcagctcgtgactattgacgatgctcacccgagccgagctaccctcgtcctcacagcacaagacgaggcaaacggtctccctttatcggttcgccccacgcctcttcagagttccaaggatcacgcaacatggattgatataatacctttcccagtcatgcgagacactctgatccgctacgaagccgagtatgaccaagttgaattcggcaacgatctagtgggcgaccttgtggactttgccaatgtataccaacttcagcgcccgaaacaaccacgtctgccagccaataagtcgtctcgatcgatcggtgagacagggaccgtgaccgctggagcaaggacgggaatgatcgtttggggtgagccgcaccgtccggaaaactgggaggtgaccctgggttttatgcagaaatggccctgggctctcgtcggttgccagcctttgctgcactcgagtaatagatggagggcactccggggcgaggagccactgcctcaaatttatgaaccttgaatgcatctttacttcgcctgttcagataataaaaactgtggtgggggtcatggtaggagaagtaacgatctatacatatagcagagacggaagagaagagagaggatacagatgggaattgaactgaattggcatatgcccctcatcactagtgatgagaagaagtaagaaatcttcagtccgatcccctaccaccgagttacacactcgctagctctagtaaaaccatcattctagtattgaggtcagcccacagtggtgttcttgctgtcaccccatatgacaatctcgttgctagttccttgagataaccatctattgagttcaatattctggacagcacacgctgtagcatattgcgtctagtcgaatgtccgacaacgaatgtaagcatctctgatcagtcgattcgttatttaattacaaagtagcagaaaactagcaaaaggctctgtaggatagactgagtataaagttcaaaacagcaatggaaaatgacagagcccgacgtaacgtaagagaaagattataaagttcaacagtaatggaagatcccagagcccgataactcaactcaatcaatagtgccaagataatgatataaagtaacacgctcggcttgttatcatcatacgttctgcatgcccgtcgtgtgcgtaaatagttgtgctgaaaatcatcctgctgaaacgcagcatcgtctgatacccatgatccaggtacatgataatcgcgtgtcttacgcgaagagtcaaatgccctcatactactcgccgtggctgctttcatgacgcttgggggagttgcctctgttggggcgtgtatgcgtgtcccatgggagtgagttcgactagacgctcctatacgccctccgctacaacgaatatcgtgggggcgaatcagacggcggtcttcggcgctgaggttatgggtggagcgaggtatttcgacgtgagtcgactggaggcgaaccaggcgacgttcttcagcgctcagattaagggtagagcgaggtgtttcaacgcgagtcgactggtgcacccgttcgaatatgccatggcccctcagccgaatatcaagttcggcgacgttttgtttccacaatactttgataagtgtcccgtaggacttgctctctagatggaaatcgtcgtcctgccagcattcgcggagaattttgaacgggatttcgtgaatgttcttgatgttaacgtaggacggcttcttcatagtctttcggtgcgcgatagcgagggtacagctatgatccgggtgggaggctggtcgtattgggaggtaggatagtcttcggtcagggtggtgatggcgtttctcgatgggtgtgttatcaaaacttgtaacctagccgcattgattagcaaggtctttcaccgagatgtgtcgtgatctggggagcgggagctgacaacaagaacggccacgtttccttggtggacttgccgcgaaatcacgacgacgggatggttgaatatgcctgtttcgatatcttgcgtcgatgcaaaactctccgcaatctcttcttccctggggagcatcatgagacggccccctagacgcaggcacctcggagtttgagaagagcgagacatggccaggtgatgaattcagttctgagtggtatcgaaacagcttcttttctaatccacgtcaagaaaagacaaagtcgcgttgtcatcgctggcaaggctgggcagcaagatctttctggcaaatacgcgcagacgagcctcaacaggtgaaggggtccccgattccctgtagtttggcatagcttgtaaggcctacgggaaaatcgagtggtggatgtgcagacggctttaaccaaaaagcaactgacacgatcaacaagctaccgtcatggtgggcccgtttcagtctagatgttacatgcaaagctggatggatcttcagagttgagtatagcctgacaccatcaaagaggaagaggggatgaaaatccattggttggtcggaacttggaagcacccattcaagcccgtggagggggtgcgggttggggggcaagctagtcaaagaaagagaaaaacgcaagttactacaatcaaattttccacaacaatacagtgtcattattgtttgctaggctccaaccaaatcggtaccttcaggcagcttgttcacaaacgtaattcggcatgtttgtgcacggcaaccccggaatataagcctatgatcatgagtgagggctgtaaatgaccatgagccaacccccaaagtacttcttctcttgccccgtaacttgctgcgggaggccaaccacaggcccttgacctcaacataaccatccaattgacagccattctcgcgtctcaggtctcaaatagctttaaacacctcgtgttgctaagacataggaacttgtcactttgtcattacatattgggaaaagtttgatctgcctcagggtgactcatggagtatcccctgcctccagtactagtttcacaatcataattgactggaaaaaggaagaagttaggcggttgaggcacgcggagggtaaaacctgctacgtcagagtgttatacctttcctgtttcccaattacagttgttccaagcatgagtggcttccaatccagtttttttacagcgtgaatttcaacaaccaacgtcaagtcactaaacactgacggtttctaccaatttctttcctctgaactttgactgagcggctaatcacggactggtcattcacacggaaaatgtatccaacaaatgcatcccaaacgctccgtttcgttctctcccaatatactcccgtctgttctaacaagacctgaacagtagtatacaatggccgcagctctttatctccaatcctctccttattctacctcacaatgttacttatagggtggtaaaggagaagtcttttataaattatgtgctgcgaagaagaacgtttatatacatcttctagtagccctcactcaagcgccactcaatgtgaaagatctcccctcggcactcattgcaaaagtcctctttgagatttgaacctcaagttaagcagtagccccacagagcctaaaagtaaaatcaaggccatagtagagttcgggtatcggttcatatccgttgtaagtaattaactccttgggagtgttagcaacaacaagtgttacctcttcgtcaacggagacgccagttgtagctgtctcaatgacatcaacgtaacgagttgcgtttgtctttccgttgaaaagagcaagcgaggccgtataggtcccgttggctgtgatatcgacacggacattgctgcttgtgacgctcaatggtatcatgctggcccccatatagccaggactccgggctggcttgacggtgtagctcccgttgccattttggttaacgttgtcaaatgtcagattgctgtatttctgccagaagtactcgcgggctacgggattatcaatgtccacgtaggccatccgagtccagtagcgaccaacaattggaccgatgggcccgagaatcctctggagagtgtgaagaggggtctcaccactaccggaccgatactgaatgtttatctgacgcatgatatctaggccagcattcgggatgttgtcaagattggttgtcaggtatgtcatgaacggccatgctcgatacaagttgccgttggtgccaccgacgacgattggtaggtgagaattgcccactgtcacatcaggatagaattccgtcttatcaactggtctgccgtgtgccgcgcgggcggcagcacatatgtcggacgttttatatgtgtcagcgaaccaattcgcccaagtctcccaccacgcgctcgtgttatcctggtcgacccatctcttctgagaatgcgttacaatgtggccatactcatgagacaggtaaccagcatcatttatatacttggggtttatttggagccagcctaggccagtctcccagtccgtattcatcagaccccccgcatcgatgtctggagagtagtagacattggtcttggtccagggcccagtgtcatcctcatcgtagtacgaaagacccgtggaccgatatcccaatccgacgatgtagcagtcgtaggatgcttccagatgagccagggcaatgtcggtgctctcctcggagcccgtgttgttgtaaagacggaaatgcgccgagtctttgaaaataggaccgccgccaccaatacttgggttggcagtaaagttggctggctctgctcgggctgttaccaccttggttccttggggggcggcccaaacatgctggaatcgcagaagtaagccgaccacaacagcctgctttttgtagtgcattgtggaaatgtcaagaagccctcgattagtttgtcaaagggtactgctctgtgctcgtctcgtgactggtgcccaagcggcctatttaaatggctgtatccctccatgtcataccattgaatattgggtcccaggatgccgagtcttcaaaggatttaccgagttatttggtccctatcaatgtcggacaaccatccggtcggaagaccacgtaggccgctcgcaatatgttcccgtataagattggatttggcggcccaatcggggagttggcactgcttaatcaaccagtattagccggcagcagatcccgaaacctcgttcttcaaatcctattatagcaggtggtaacgtcggtgcgctaacaagcttgccaagttcctcgcccacggaggggatctcctgaccttaggctagttgcacgttctctgtgagggttgcgagctatagcggagcgaaagtatagcctgaccagagatacgaattgccatcagcaggcatgtcgatacaatcaacccagggagaccccaggacacctgagtaggtatctcataccatgtcaactgataacactgccctattgcctccttacgactgcatattataagtactgtgcccccaaatcttctggcttagttggagatgaggagaattgactccatgaccgtggatcatattaggtatgagcggcttctttataaattcagtgtgtatcaatgaccaatagtcatattgacagaacctaaattatctctacctaagcttttatgagcttcaatccaatcagtaggcgtttccccttcctgttctccctggtctaacaataaatacaatatcaaactaatattgtagaataatttattcttctcttattattgtgtttcattctcttgttgtgctgaataaaccgaaatccctgccttacgtgaaaagagctttgttgcgccatgctttatttcggccacttgccatcctgctcacgcaggtgagattcactacttcatgcccttcctcctcttaccaacacgtggatctgtaaatgaagtacctggagtatcttcctgccccggatccgggttgctcggctggatgccctgctcaccttgctgcgactgcgacaaatgatggctctctaagctctgggaaagcccggtttccggaagggacggggcatcgaagtctaaatcggatggtatctggtcgatagctgaacatatattcttcaagtgagccggcatccatgtgtcgtagacgtttctcgtgaagcgatacgctgtccatttctccttgccatctaagtcgtcgaagtagaatctgtggactgggtggcggtagtacttgatgctattcccatctataaccggataatggccgtagattcttacggagttgtgatcatgagagatagagaagccaaggatctgccgatggacctcgccctcgcgctttacagcacgaaagagctcagcgaccgcccgtaccgcgagggtcatgctgtgggcattttgccggtccgccacgtccagcgccgcggcgccgcacttcacttcgcaggtcaggaacgggaagtacaggtaataggtgcccatgaagaaggattggtctccagcgagaaagtcgccaaggaatggtgataacttggcgagctgctggtcggtgaatgcctcgcgtctaaagcctacagagtagtcaggttgaggacgagccccagccagagggatcgagttgttccagccctcgttgacactctcaaccaatacgtcaaggtgcttggcgccaaatgtggcaagactctcagctgagggaacggtcgagtgatatcctgaataacgcgggcctcgtttctgttatggatcttttggcaagttgattcgaaaatatcgtcacggaagagcgaatcctcaggaacaggttgaggcgcctcgagcaaagacctggtcagagttttgcttgcactactgatgtctaggctggatttgcccatgaaactacctttagtttcaagcagtgtctcatatcgcgagtctcggtagggcgcactcttctcttccctcggcttctgatcgctaggcgttgccgtggacgcagcggagttcgaccgcttgcgaccaagagacgataaggactttttccgggcaagcaactgctccatatcaagctcaaaatattcttgcggccactgcccttgtctcgcccaaaattcgatcgggttggtcggctcggtcggctcgtgggtgataccgtggattatcccgggtctgtctggagtagtctctgccttgggagtaggagatcgccgaggccgcttcgaggaggagtcaatgttgtgatcgagtgcgtcaacgcgtcgtttcgtagtatgcttgccagatgtcgacaatagttctggagatggaatattcttggctggagatgaatgcgattgatcggaattggagctctcgcaagtcagcttctgttggagacgtgtcgagcgacgacgagtggttctgtgctgagcgacgccctggggccgcttttctagtctcttgtcagcaaggatttcgctcggcgctttatgaaacgtggagtgtgtaccttggtcttttggcgccgatgatgcatgccctttctgggggggcagccgggctcgaccgtgagccatggcgagggagaatgttgatgggtgatgatgcgaccaagtaaattgtgtgggggaagtctgctaaccaacagttaagcgccgcgagtggagacactgccccgctccagcgattcgccgcccataatcaataacggcttaatgcataaggcgaaaaggaggtcattgcggaacaacgcaacacacaacaaccagagattaacacagacattattgacccaaataagcgctcatttgaattcagccagagctgcttgtggagcgctggatcgcaagaggagtggcggtttgcccgcgtttcattttgcccaggagctgcccaaaaagccactcagtagcgattgtcgggccttaagatttggacccgaactgcagaagtatcacgcctggtccccttgatgcatccgcagacgtagctatagctcagtcaacattaatctagcttggttttcgcttgttactagcccagacctcgctcggatcttatccttgttcatcgtttctaagagtcagagtcacggcatttgaagctgctcgtttgtatgggctagataccctatagccaaagccttctgctatttaaggcaacattaaacggatcgcaaaatgaagaaagaggtgagttccaatcttgtagattctgtaatagaattgatcttttcaatgctttaatcgtttttttttttttcttaaatttagtggcttgttgtagctaagagattatctctcagggttctcaacttgccagtacaagttaacacagactcccgggcttcaggactcaatcaactaatttctgacatcgaacatgggtgaatgaacgggctattttaagatgttcgaagatttcaggtctgtctcacctccacgtcatcatctgataacctctcctttcctcccatcaagacaacagtgcggctgccttgacaccgctttagctaccatataccattacctagccttcaagatgccacacctaaacagctggttctatcgcatcgccgagtatgtatacgcgctccctgagccgccgcctcgcgtgcgaacaaagcctatggaggtcatatgcatcggcatgccacgtacgggcactgagtcgctccagcacgctctgctgacattgggtgcgaggcttttcatctcaatcttccggaacgcgcaagctcgctgactctcgcaggttacgatcacacttatcacggttgggatatcaattttgagtctcccaactatgctcagcaatgggttcgcctctgccagaaaaagtgagtagcaataatccgtcaaaaagtcatatatttctgacaagtaaataacagatggtacgctcctgagggcggcgacgtccaactcacggcggaggactttgacaaggtcatgggacacgccgtcgctgttgcagacgctcccgcttcagtcttcgcagctgagcttatccaagcgtaccctgaggccaagatcatcctcaatcaccggaaggatatcgatgcctggcacaagagcctgatgggtactctggcgcgagggcccacgctttggactttctggatccttgcttgcctcgacaaggagtgcttttggaattggcaatgctatcttggatacatgtggcctgggctcttccgtgccattgatggaaaggttgagacggggatgctgcgcaacgcaaaatgggtctaccgtggtatgtctctatcccacgctctcgcctgattcttcaccagacattttgtttccgggtcggactcactgacaggagcacgtttagcgcactatgccatggttcgaggcatggtccccaaggacagactcctggaatggtctgtcgacgatggctgggagcccttgtgcgagtttctcggcaagcctgtcccaaaggagccgttcccccataccaacacagcagcaggttttgctggacaggagaagaagctggcaatgagatatgtgatgggggcggccaaaaaccttgcaatcatccttggtacaatctcggtcggggccggtgtgtgtatgcttggtaccgctagcttcttgcccgcgtcctggtgcaagtaagataatgatcaactttgcgctttacactgttgggaggtcatggctcgatgtgggcagtttattttcttggttgcatcttgtgcacatttttcttggctgctgggagttcgctagcaaactaaattttggcaacggtttctacaactgtcaaaccagcccaaatcaagtgcaattcagcttcaaaaatatacacgaaatgtacatcggacatattcttttacctgtctacttttaaaatctaagcaaacctgtgagaggcaatcaaagtgcgccctcgccccaagcttgagctgactagatgaggaatgccaccgctcagtttcagggagtctctgagaacaaagtcagaaggcggtgaaaatggcgcaagtgcctatgaccaccctccaagccaaggtgatctctccttttcctcatcctgcaatctatgttgaactctaacttcttcttgatcctccaagccaaagtgaactcttactacttcatccttcaagccaacgccaactctcccttcctcttcatcattcaaagatcccataaactcaagcttgatggtctttgcacccgactcactcacctcacaaatttctttgcagcccgtgagcaagattatgcgaagtcatggcccaacttcaacctcttgggcgtaattcgcaacccttttgcaacccacggcaaggccgtattatcgacccaaatgaaaaattcgatccacgcaccgaccctcgatcagccgttccaccggctatccgtgacggacttgggagctgttctgaatccctgactcgaggatttctgaaggataagatctgtgcttgttgggacttgacgggcatcagcatgctcttccctttgatgcactgctacagaactcaccataaggttattctatttcgcactaccttttcaaatctttcgattgcaaactgtacaattctctggcgggctgcacagaaattttccaaggaagaagcctgggaagaagtgaaaagggcatttacgaaggctcacgcaagctacgatggcgaagctgacacgatgaaaataaaaagttgggctgaagatgaagcattccgcattctcgcatgttcatccaatttcttcttgctgtgggcctccacagacctcctccccggctgtacgatgttttgcattctaaccatggttcatgcaggcccggcacattgattccacacaaaataccacggctaatccatcgactacattgcaacgtcaactgcgggccactgccgcacggcttaacgtggacaccatcgaacccgacgtagctcgagtccaagaaccagccaagggtgctctcaggtccctcaccgtaaaatccattgtcaatgagttctcgagcacggaggccacagatcatttagcccaactcgtcactggagtagaagaagccatttcaagacgggacaagttcatcgtcgatcagctacacaaggaggacgccaaaatcaaacaggagctttccaggctccttaaggaaaaacagcgacatgaaaagacggaagaagtccgtcttgggattaagaagctcagaagttgcctcgatgtcctcggtgacgatgacgagcctctgctactacatagtggtgcaaggcgagctctgaatgcgctcgaggaggaaatcaagaaattacccatgaaacgatccagggactatgaatcagaatcagcaaccctcaaagcaaagcaaaagcggatcaagacacaagttgagcttctcacggagacagaatgtacctttcctgcctcggatcacctcaaagtctttaaggaataaatgcccgcggtttgagatctggctagaggacatacattttagcctcccagcacagcggcaaaaggctcaacgtgctgaagaaagcgttggcggaattataagatggccactctgaccgaatttgcacaatttccccaattttcaaagcaaaactgtctcacaatatccgtagctgatcagtcaaatgctcggcatctatgagactgtcctattccaatcgaacttgccaataggaaacgatagctttatttatgaacaatgattctgggtcttattcatacgtacttcaaattccaatttagttttaaagcatgtgaaacaaccaatttccagtgaagcttccttgatcttcctaaagcgagaaatgacctagagatgcctagaacctttccgtctcaatctgggctggttaagtcaacaagaagtgctcaatgggatggagtttccaactccaactctgtaaaatcccaattttcttgacagccttcaccttgcaacctccgtaagcttcacattaagctcaccctttgaccagagactccagatcttctgctggtcccattctctactttcaggcattatctctagatcaaacttccaaagaagtcgagccagaataagacgcatctcagcataggcgaggctgtggaagatcagtattttcaaattaaacatgagagcacagacgtaatacaaaaacctacttcttgccaatacagtttcttggaccaatggaaaatgggttgagaaccgattttgcatccgacttgtacttcgggtctccttctggtagccagcgctcaggaacgaactgctgcgggtcacggaaattcctgtcgctgtagtatgatgacagttgcgagaccgatacagatgtctagttggcccaacaagtcagtaggcagaatgaggcgggctttggcgaggaacctttgatgaagttcccccaggggagatactcactccttcaggaacccaatagccatcaatgaattcgccaccagaaggggcaagtcgaggaaggccgattggaacaggcggatctaaaacaagcttgtaagcaaatgaggcgaagatcgtaccaggaagacctacacatccgaaagccctcattcagcgtagcgatcatgaaagggagttcgttaactcgcaagagcgtcatctcctcctccgattggaaagtagacctgatttcctttgtgagcttatcgtatgactcccgatttttcaagagatggaaggttgtgccactgagcagggtcgcagtggtctcactacccgcgatgattaaaattccagcattctcaaccatctcgcccctactaagacccttctcaccgctatggcgaaggatataggacatgaaatcttcactctccatgtttccactttctactcggttcaaagtggtttcttttgtaagcttgaaatgctccttgctcctctttatgagttctgaaggcatgaacagcttggtcaaatactttagcatcggatgccgcttgagaatttgagacaatgatgaaaactgaacatcgtcaaagatcatcgatacccacggatgatagcctccgctctccaggcatccgaaaggctggccgaaagataagtcaccgatcagatcgaaagtggtaaagttgaaccacttgacaatgtccaattgctgtccgcttttggcgtgctcactcatcttggtgatgaacaagtcgacatattgtttcatgatggcctcctgtcctctaagagctttctcggaaaacgcatgagaaattagtcgacgcatgcgcttatggtcctcccggttggcattgatgatgtggggatcatccgagtgaattgaagctccgtagaatctaggatctttactaaagttcttattggctaatgtcttgtggtcgtatatggtcttccaggcatccgctgtggtgaatgatacgtctccaggagtgtatctgaccgctggtccgtatttctcgtgaaggctcctcagaacatgtggccaggttcctttggcaatgtgatacaagtatgggagatctgtgagggtgtagagtactggtcccggaattttcgatagtgggtggaagaagaccaggtacaggctcctgactatggtccagagaacgaactacataattagcacacgatcgatgagcacggagcataaaacttacaagtacaccagcgccaaaggctaggtagagagagagtccccgtgagagttccattttgtctgcaaatcgagctcaaagtttgatagctaggccagtatagctgctaaagcagcatcaacacgtctacttgctattcgagggaaaacaaatagtcagcacctatcgagagtggtgcccgggcgacttgaaaggatgagatagattttaggagactcgtcggtcaacagtgctgggaaccgtctcatttatagctacgacctcggtttctttgtcatatctcggtgtttcctgaagagcttcatcccggtattctctccccctcgtgcgcgcgcgtgacggccctctcggtaaatttcaagattttagatcttatgtcctcggaaaatccatatacaacatagggtgcgtcacgcgcggttacatttcatggccgcctgcagattctcagcgggccgtcgtaacgcaacgaagcctttagaggaaaaatgaaacccatcaagtggagtcaggaagcattgacgtatgaaaactggatggttacgaatcgttgacttgacgcttccaggattcgtgcatatcagctcaatgcaagaatcgatgctacgccactatgatttcatactcctggtcttgatacaggaagactagctctgctgcaagccgtatcactacagcttaatattggatgaacacttgctgcaaaggaaggactttggtgttgtttgttgccttgggaaaaaaaacataccaagtacctcaagcccatcagatttatcttacattgatagttaagagagttactgaaggcaaagtctacactcccacaatggatccatgctggcaggcaaggggatgcctgtagaatgtgggtattcggggtttatgtgtccactcggagtcctgtgacggggagtcttgacacccgataccccgatgaatgtaggaatatatgaccgattacttttcatcccccacgcgcctttatccaatgtcagttgaagaaatctgatggcaataaatggcttccttggctcacacaaggctagcccacgtagatctcccgcctcctcaacttagcccccagaccccagcacaactagagattacgacgctcttccacacctgcctgttgtggttctacctgcatgcctagtagtcttggccataaaatgtagttgtccattattattaataaagacaaaactatgtagctatcaacgcatagctaatctatagacatatacctattagtccactactccgcagttctcagggcgaacaggaattcccgaaatagcaaaagtatcccaaaaaatgacctctcatcagtgatagaagacaagtccggcttctcttaccccgcctctaacagtccaaggatagtagtatattcctctccctttccagttgctcttctaacccaagccgccagcaggagaccacatattaactcgtagtacgacaacccttagtctgatttccaatcaagtgacataacgacatgtcagtctaaaatatgacagacagaagttacagtatcattgcaagctcattattttgtgcaagttctgggcattggtccagtttttaagaactcgacggtcggccgcctctcgcctcccaggacaatatcaaaagtagtggttccttcaaccttcgtagctgttttgaattctacccacccattgttcttcacgcctgtagattcgaaatttactgtctcccattctagggctggcgtaacagcaacatcacgcttcttcttgtggacgacttccaaagtcagaggcttggaagcttcatcctctcggaccatggcaatgacagatacgggaatcatgccatcaacgatgttaccactgtcaaagcaagaatcagacagctggtacaaaacagtatcgtccacggggtatccgcctgttccttggttgtcatagacgacagtttcgttggtggaaggcgtagtttcacgaatagtgaatttgcttattccagtcgcaccctttacggtagtctgaaaattgaagttgatgaatgattcaccatgaaggccaatgctgaggccgagtttataggtctctttcacggcagtaaccacatgctcttgagcaccatctctatcgtagtagatgagatcggcagctatatcattgtaatttcgacctgagccttccgtgactcggaagcgaagggagcctgtgaaagtgatatcgccgccctcggtcaaaaggagcctgccgatgtacggcttaacttcgtatggttcaatgacatcgctcagctggacattgcttggcacagtgtcaatcatgcggttgaagatgtcggcgcacatattcaggaaggtcttctcgtcctgcatcttagtcatggtcgtatttccatccgaagaaaaaacgcgtttatcggcgttgaaggtgtcattggatgccaccaccagaggattctttgtggagccgtcgaggtactcgttgaccactccattattgatcttggaaacgtccttttggaaggtgacaagcgtatcattgctagggtcggcggggatatcaacaatctccgggctgttgacactatgaacgccgccgagcgtgtgaccacaggcaaccatggttatcatttcttccttggtaaaccctgccttggagaaagtctccagcacggtatccaagtcagtgtgtgcctccgggacaccggaagggccagcttcggttgcatctatccgcccaccgcggtactgcagcttatttccgccgcatgcaccgctgacagtaaccacacccaaagctactagatcggcggccgacgaacgaactgtatgaaatccactgaagaatccccaggtattgctgaatgcactgccttcgttctcggcgcgatctaattcaaagaagatggatgcatccacaccgccagttcccaactccgcattatgtgtgaccatgtcatggaaggccgttctcaaccactgtgcggagttgtggcggcctttttcgttttgagcaaagtcacaagggttcacagctgccggtaaggaggtaggtgtaagcgagatctgcatccaatcaagtgttatagatgaacgttcttacagtcaatgaaaccctgccggttgatcccagacatcatggtaaaaaggttctcaagctcgtcccacttggagggccagacaagctgcccagcagccacagagtgggccaaagcgagagtagtgatcgcaagcgacttcatagtgagaaggtcacaatccaaaggatgaggagaatatcaacgaaggtggaaaacgggaatggggacgtctgaagcagagacgggagtgctagccctacacttatagccggcgtcctatttcaatctcctccctactccagccatcacgaccaggttccgagcaacctagagcctacagaactgtcttggcggaaacggcccggccgtagatggtttaggaacagattgagaatgtaaagccccgatactcgctccaatcattagaaggagatttgtgatgcaaccccagtaggtgggccaggggtcccttttctctcgtatcaatttaaaatacgaggccggctcctttcctcaacagcgcaaacccccactctgaaataaaatacccttgtcttcttgaagcttgggctgcggaaaacatctgggtccaccaaaattcacggcacttgagagggagcggaacttggcaatgtcactcttgcaatcctctaactaaaatagctacttaagttccttcaattgagttattactattctatttttatcgtgacgtcaccgagtatctatgctcaaaacaaatttgcatctcgaaaacctggctgcgtgatgtcgctactagcagttgagtcggataatgagtctttatgacgaagagactgtatcttcaatcgcttgggggcaaataatatccttcatgagacaatgggtcgtctgaaccccaacagcgctccgagtgctgggggttgaggctcactagtagtttcacggtgttgagctcgtaaggggtagacagtcagatatggcattcttttatcatttttcagacaatagctcttcataaagaaatttaattccaggtaaacccatacagaacctctctaagccttctaaacggaaaagagaggaaaggaagaaaaaggtaaatagctcgtaagctttctaggcgacgctggtcccagactgttaacgagaccaccccaacgagccaaatggctagtgaaagaccttgtatattctagttagaacatctggctcgtcgtcatcatcctctaagatcgtgtcctttcagaaatcaaggctatggtgaataacggaattgaagacatcgggcctatttggcttgtctaaattcaaagttgcacttcggtattatcgtttcctctagattaaaagtcatctgccactgcttcagcagaaacaagggccattatgcctcgaattcctctatcaaaatctacattggccttcttgctcctcaagatttggtaagatgagtcagcttgcggcacagccctgcaaggcaaacctggaggcttcgatgacttccccgcacgatcagcctcagaagcacatgaactcgcaagtcattgatccatgatcatacgtaagaaatatcggtcagctgtgctccaagtctgatctcaaaatcgcaaatcatgaatttcggacaatgtgggctggaggaccactccctttcccctccaccatttcatgacacgctctgtgaggattgtcgccgtatcgatctaagcactcttcttttagcaccaaatcatagcactgtatcttcgtttgaaccagccagcgcatacgaggacaaggcagcgatatttgttaatcacttttatccaaacaatgacctcaaatctcacaactgttctctttataccctccttgcagagtgtgctaggcgagcaggtatcgatggcagactatcgagagtgcgatgctgccttcgacctaaactccgttggtcacatacacctgcgtcaaattcagctttgaaaggggtaccggagagccaacttaagcacagcggccagatacatgtctggttccaagaattgaaaactctcgagccagtcagacaaggatttcctatgccatcagcaagccgcccttcaacaccaagcacacaagaccttcttgcgtcaatacgacacagggcagaatcaaaacaaagactcttgtcagaatttcgccttcgttcaagaaatcgcccctttcagccacctgaagttccagaattaggtccaactgcagcctcaacctccaataagggtaacgagcccaaggaaatcccagggcaaataagagagatattatccggagaagagctaaaagtaaaaaatttcaaacccgccgtcgccccatggatgattgatgtcatagggtcggatagtagtggtccgacagcaattagagcccccattcctcccattaccgatgtcaatctgctccgacagtggctttacgaatgcaacacgaagcatcttcatccgcagcagcccctgaatcaatattctcgaattggtgaggtgctacgtcgtggagtactgagagctatcaacacaactacaggagaaataaaaactcaggattcattggtgcctttcgtagccttgtcttatgtttggggccagacggcgcaccttaccccgagtcttgaatcgaagagcattgcggattatgcaccgtccatacgagacgctgctgagctcgccagatccatggatattgcgtggctgtgggtggaccgcatgtgtattgaccaaagcgacgaagcagagaagacatttctgataccgtatatcaaggacatttttgccgttgcgcagctgaccatcatatcagctgcaggagatggagcccacaatggacttccgggaacaaaggggacgccgcgggagaaagaaagcatggtagaagtgatgaatggacctgagaaattcagcttgcttccttgccagcctagcttcaatgcattgtatgaaccttgtgtttggcgcaggagaggttggaccttcgaggagcaagtcttttccagccgtgttctctacattttccctactgaaatgatatttagctgctgcaagggaacatttagggagtcttcacggctgcacttctcctctggcgctgcgggctttggatggggtgacaatggagcaactccacccatcgttgcagccgagataaatgccaagattcactctgcactcccaggttctggctactccttatctgcaagagactttggacgagcggtggaagagtacacatcaaggagccttacagttgagggggatagagtcgttgcatttgctggtttaataaccatatccgctggcaatcatcctagcaaccagttcccggagagagcgctactcaaacatggacacccgcctcagttctttgaaacggcattgacttggcaacacgaggagaactttcaaaagcgacagccacgcaatgagaagccattcgtaccgagctggagctgggcatccgcgggtaccaagattcgtttccttgacaatggagaggagaatggccgaagctgtttcttcaacttcacttgcttagacggacacgatgttctggcaatacctaggcagtctttcttcgtacctaagagatttgcgttggctgagcccctggatattctcctatctcaaccttggatgagaaaccgcagcgttcctctcagctgccacgaagcagctagtcctcttctacaggtatcttctcttcatatggtaacggtagtttttgatggtaactttgcgcgtcaagacaaagacgtgcacagcctagtcggtctaggtgacagccatgaccaggatgcacgactccaaggaaggtggtcagtagatatcgacaatcgaactgaggctggttcaccagcaggaaagctattcgctatcgttgcaggcaaattaaacatatttgtcatggcgcttcagccgacctcggaagaaaacatatacacgcgttacggactttttcctgtgtcggtttccagtcatcgcacactgttcgccatcatgagaggaggaaatctgcgttggcagtatgtctcgattgtatagaatatctatatagttttctttatcctttgttgctagggttggaatttttttattacatattcaacagtgacccttgacactggcaatgctgccggagagaagcccttgtcgctctataaacgtagagagctgcttggtgtagacatgcaccgctcgaggtatcacaagggtcaagttcttcaagcctgtcatcgccgggtgacaaacaaatagatttaaatctaagaaggatttggaaaggcaatatattcatgaaattatgtttgttgctcgcacagtagctgggtatctcaatcaacgaatcactcaaagggcgactctcatcgccccctctcatctccagctcggcaggctctacacctgcaatccgctccaggccacggcctgcgtctgcttccgaaccttgtacgtcccgtcgggcatcttctcaaagtactcgaacagcccggccatggacccagccatcttgtccgcatcctgctccgctccgctcgacgaccgcaccggcaatgcgcgcccaccgctgcgcgcctcctcgaccgccttgaagaagcccaagtcgtccaggatctgtcggatctgcgctgaggagagcccgaccagctgcgacgggacggtgggcgaactaggctcgccctcggacgaaggcgcggggtggacaaactcgggcacatcgtctctgatgcgctcacaggtccagcagatgcaaatctccgatgaggaagaggaggaggactcattcgagtccagcacatccagcggctccgacgtgtcaggggacgacagcgtggccgacctctgctgcgtcgtctcgatgtcgcgtccgtcctggtatttcgggtaatccctcatcacgcgctggaagcactcgtactgctccgagtacagacggtgcgtcctccagatgagctcgacgccgaaatgcagagccctatcgccatccatcgcctcgccgccctccagcagctgcagggcgaagtaggccaccgacgcgcgctcgagcgacccatacagcgacggcccacggatccagaggagcctgtgcgcctcgtctatgaagtcgtcgtggcgcttcgcgacgtcgaagaggtcgacgtgcaggtgcatgtcgtgctccgcgtacgcgggggggtcgcggaggtacgagggcagctcggcggactggccagacatggtgtcgaagagcacctcggccgcgcgggggagggcgtactccatcgtgtggacgtcgaggacctcgcggagggcggcccaggggaagcagagctggcggacgtggtcggagtggcgggggtcgccgcactcgaggcggtaggcgtcggtctcgagcatgaaggtgtaccagacgaagaggacgtcgagcgggggcaggtagtcctttgtgagctggacgccgatgcgctcggtgggacggtaggcgtagatggcggcgtggttgaggacggcgtcaatgttggcccaccacgcctcgaagcgcgtgacggccagccggatcagggtgtgccatcggtgcgtgtcgtggggcgtcgactcggcgccatcatcgtgggacagcctctcctcataggcaggggggcagtcaagctcgacctcggtggcgctgaggcggaggttgtagaaacactcgagcagggcgaggtggacagcggcgtggctgacgtcagggtagacgagagggttcttctcggtgttgtactcgatgtggcccgggatgtgagcgttggcaaagatctttgggtttgggatcacggtctggagcttgccgcccggcttgggggtgggatacgatgagggggatggcagcgtccaagaatgaggctcgagcccaacttggcttgctgagatggccttacgaacacgattaagcagcaacatgcgctggatggatagatgagtgatacggaagagtacgaggagcaggaatcaaacaatgatggagcacaagggggaggggggagccgaggggagggtctagcttatgaaggcttggacggaactgggacgttcgaggtaccagagacaataagcttaattttaatccatctaccggtcggagtgacgcaacttgctgcttctcgcttgggagagagcacaaaagaaagggcctcaaagcacgaagaactgcctgccagcaacggagtgacgcgcggcgaacccgcagtaggttcttggcgggcgtatgctagtgagccttggcattactggacatgagacctcttagttggtgaaaagcgactgagggctgggagttggaggcctgtggcaggggtgaggcgatgatgggcagggccatgtctgagaccagctccccatttgcacgctccccgcagcctcaactctcttagcctagccctacgagcgaataacgtgcgtagtcagagtctagacattgggcatataccgtgcgagttcctatcaggcctagtgtgcggcgcagataatctagatatctcgcgggtgggaggaagagctggcggttggcattcagatgttccgtcacatgattgatttggctggtttacatgttacaatcatcgagcctttcttttctcagtagctatccattcccctattcacgatcagtccactctgcaggtgggtggaggtttggtgtcgggcgtaactactgagtcaaggatggccgccaagaacatcacaatttggcctttgtcaccgcatcgtcacgctcttggataaaagggcgagtcattcaaatttcactcgcatgggtagcacgaatcaaatggaacaggccacaccgcagttcgtattgcttcatgcacgctcttctcacatttgctgggaacatttgtgcagggtaggctgccgaatacgcgtgttggtcccagaaaaagaaaaaaaaaaaggtccattattagccaaaaaaaaaagagggcaaaaaaatgagaaaaagtcaaaaagatgttatcaatcgttcattataggaacagcccgatgcgggggtcgaacccgcaaccttgagatgtgaactcgtaagagtctcacgctctaccgattgagctaaccgggcacctttccgggtgcttgtgatgttttgaccgtctcccaatatcatctcatggagttttcacggacaagccagacacgaggctgcagtgaacatctgcgcttggaacgaggtggtggccgagcaaggtaataaacgtactgaatatacgtagatcgtctcaaaatttcacgaatattgtactacacaagtgcctggataaaatagccattaatatcgcccctcatagaacgccccccagctgaaagaatctccatgtcgtcgagaaaaaacataactcgagatggtatcgtttacttgtaaacctgacccataccgaaaaagaaaggtccctccatatccgttcccagctacgtttccatttcctcagaaaacccaccccagaatccttgcgaaacattgacaaacatgggaggcacagccatgtccatgtcgatattcatggtattatacatatccgcatcagacaacattgatacgtctgtcgtaaatggctccaggccgacgaagcctgatatctctgtctcaacctcggcttcattctcgttgctgaactcgctttgaggagacggcatgaccaaccccggtagggcccgcggctggccatcttctggggttgcaccttgcccttggctcgagctgttctcgggttcagagtggtcaggctggccaactggggagttttgcaaggcgccgtagtcgatgacagaattgtgcagcgccttgccttccgtcgtgttgcttactgtcgtgtctcctccagctttgatgttggagtaaaagaactgcattctttgtatagtgttcctctatatatcaaacgaattagtataatttcacttgaagaagtccaggtgtgcggatggaagagatacttacccaagtgtcagccattggccatgcttgcctcatttccttgagaacatcgcacccttccacaacacgagtacgccaagactggatccgggcctcctccgcccccggaaacgggaaatggaagaagaacaagagcgcccccacggccgtgtagcttgcgaacccgacgcaaggcacaagcccgcggaggaaaaacagcccaaagtttcgcatctcgtggagcatctcgcagactcgttctgccatcttcacgagctcctcgctcgagttgagcgaccactgctcccattctgctgttttgttgttgcgcagctgacccatctcgacttctgggagataagagcggtagagacagatgatggacacatggtatatggcgtgcatgtagcagtacgcctggccttggttcgagacggagtgtgctcggaggagagggggactgtatctgagacgctttggtagtgaggctcgccagtcctcaagtctggcgaggagtttctgtaagctggactgagggttccatgggggaggctcatctgcatgggatgcacaagcccactttgctacgtcaccccatatgttagcgacacgcatcgtataaccaatgagatccagatttccaacgggaacaccgtcaccgggaggtagagaaccgttcaacatctcacacttgacgggctcgccaaagttaaagctgtccatgtcacaaggaagttgaatattcatcctctcagcagacaatgttcggtctcgggctttgccgccgctcaatatactgtccatgagaaaacaagtccacgcggtccgtcttcgctcctctgctgctatgaagtcttcactggacagatcggggcttggtggatcctcgtcaaacaggcccaaggactgggccattctgacagacatgccgagatagaaccatgctcgctttccttctcccgcaccccaggagtgacccgtgagcagcagaagtacctggatgcgctgcagagttggctcatccacatgtggcaagatgagggaccttgcgcgcgaggcaaacgcgttgctggcatcaatctggctcgggtagccagtcggagagaactgcgagaagctgcacgggcaaggaacagaaatgtaagttggatgagacgagacattgatcgtgggatggtatctcaccgcacggcaatggctagaatagcccatgcaagacagtgatcaagagtctgcctgtgtatactcgacagcaggctgggcgtgtgatggaaggaccacttgtaggcgcatctcacgtagcacgacttgacttcatctgtcaggtagctgtagggattgtctagaggcgcggccagggcagaggaagagggagttgccggcgccgagtcttggagcttgatcctcgccagactcaggggactcccaatgggatactcgcgccgaccagcccgggcgcgctgggatgagaggcccgaggcatgcgcatgcgacgggaagatgcactcatcgcctcggcccttgcaccggtcgcagggcggttcgccggtattgatacactgcgcagcgaggtgagcgacttaggtcccggggtggcatggcttcaattgacgcactttccgcttcgacgccctgcaagctgtgcaggcgatggatttcttcatggccgtggcggtgatgagcatcacgacacgacatcgtttgctcttggctggtgtttcgtttcagcgaagacactcaagagagttttctctgtccagcgcaatgaccaatggggaaacctcgggctgtctctagaatctacggctgaaatcaattgccccgctgctgatgctgatctcatgctgggctggtcgtgtggtcagatcatcctctccacagataccaccacgctcactcttggttagcttgtccaactgcattggagtactgatcattcaggctcttttggtgtttcttttcaaacatggaataatgctattatgtatgttatgaccctgaccgagtagaactatatatctccctgggccctagactacaagctatttacctgtgtaaatgcttaatcttagaacccccgtagtattattacacctaggtatttttagcgtagctaagtattatttgagtgctatacctcaacatctagcctgtgagttagtacgcttggactggcattgaatagctcgcataagatcagaatcaattcttcaagcggcatcaccatcatgatgaccacatacgacaataatgaaaccgtctcattacccaagcctatcccttacaaattaccatgatttccgtaataccctgggaatgtgcaaaaaaaaacctaaaacatcacatcataggccaaaaccgatagcatcaagttcatctgagctcagagatgtataatgaccatgcagcccttcacttcaccaagagcctcaattgccctccagctcagctctaacatcggcctctctcaataattcaaggacctgcgagcgatcccggttgttctcattgagaattctttccccaagctccatgactgtgatattttcactaacagtatcgtgttcactggactccaagacctgccgcggataatgccaaagtagtcgtgctgtgaggtcgatatgtgaacttgtacgaaatttgcctatggtgcgttggaacacctcccatgataggtccagcgggctttctagcatgaaaacctgaaccagattgaagtagtgaatcgcgcttgtgacggagctcatgacaatgtcaacacagttccagttctggtgagctgcggcgaggataatcgggtccgtctctggggattcgctaagaaaggggttcttcctagcgatgccatgatcaatcaataattggactagacctgtctctcccgcaatacacgcttcttgaagctgggttttcgggccggggctcgacatgttaaggccgtgtttgagaaaatgctgtgtcattcgatactggctagcaacaggccatctctggaccatgaaatccatcacagtagtgcacgactcgaaattgacattggctccgttcttcagcaaaaagtgcgtgatccaaaactgcttgatatttatatgacccttctggcgtactgctgcaaaggccgagaggagcggtgcgcagtagatccgaccctctatctcccttcctgagccgcagaatcggttgcagacgtcttcgctccgctccgtggcctggatgtccgctccggccagaatcaaagcgcacatgcaggttacactgttgcatgcagcgacggccagtggctggcgaggatcgaggagcgtacacccgtctgggtcggcgccatatctcaataacagacagagtgtctcccagtctcgctgggctatcaattcattgagggggttggctgaggtgtcgtttgatccctcaatggaggcccctttcttgagcagtgtctcacagaataaccgtctcttcgttttgagagatcccgggttctgggaaagcttccgcagaagcattgcgtccacttgctctcggtgtttgtcggataatgcatgtctcctcctctccgacagttggatagcatctatgtctaaccgtgtagcattctggatattttgaaaatgcaattcagtaatgaaactgggaaccaatggctgccagtttatctttctagctgtgttattgtctgccggtggctcggggtggctggcttctcgctctgtctgaggttgagggcttggagacgctatggaaggctctgggaccggcgaggtaaggagagaagattcgctcatgccggcttggctttgaacatccaggttaaatgaagaaaaaagggttgtatgggaaatgcttgtcacatcgttgctttgtgtacttgcaagatctgaactggtgaccgtagataagtgtgtggtcgacggattgctcagcggggaactgaacccagtactgccctctccactttgaaagctctcggacggctcattgtcgaatcttatcggtgctttttcatcctttctgttaatctgtgagtcgttttcacttagtgaaagtgcaggcaattccgggataggattggtggtgatcgcaggtcttgccggttcatctggatcaaggatggtggcctggtaggctgtctcgccacatgtcgtgtagtcggccatcttctcgagccactgttccaccttggtttgcgattctgtcggcgatgcttgtgtaacaagacggctgaggatctcgtctttctgaagaatcttgaccacctcggccacctcacggatcacttcggtatcattcttcacctctccaacgatggaactgctcgacttgttaattgaagctgcaagagttggtgggtgcttaccgacattgacatcagatgaaggccgatgcccagcgcgaccttgtaagactcgagcgattctctcagcttccgaatctgatcgaccccaaacagcgaccaccgcagcttcagccagagtgtcaatcgcccccggtacttgaccaagagcgattcaatcttctcaactaccgccatcgcaccggtaacagcgctgttgatctgctccaggagagggatcagcatcaggttggactgggcgccgaagcgggagagcccagtcgtgagtggggtaataaaggcttggaaaagggccagctcattggaaatatcgcgtaaatcgtcagatgcgtcgcgcaggtcgacagatatctctgctatggtggccaccgtcttcacgatgccggccgcgagtgctaccgacgcagcaaccacagagattggctccatgttgcgttcatttcttcgcttctcgcatggaaatggtagatggaagagagaggaatgtgggagggctgagggaccaaaagcaagacatgagctgagcctgggctgacatgaatggagggacttaggcgccacagagtatgcacgttgtgcgaaatatgaatgctaagcaaaagttcacccctcctgcagccactggctcatttgggctatgatgtgccgcttgtcctgcggcacgatggaggctgagttatcatgtccactgccacaccagtggtttgagggtgttggttgcctatatttgggtgtcttcttggcatccatctggccaaaagggtacaaaatagtgagattgaaatctctcaaagtctcgagccaattcgcctatatcggacaagagtaggctttattttggttcatcacaaatggtatctgtgagatgctgcgccaagaacgttacgacatacagtccatccaacatgattggtttagtgatccccccagcattggtaaccctcatgctgtgtctaccacaaaaatctgagaaaatgtatgtttctggtatgggtgacatttgacgtgatgctatagcactttccaaagcttgaccacagacttattccggctcgcccctccgataaaaactacttcttcgcccactactctttcgaaaatatggaacccaagcttatgtaggacgttgaggctcccaaaattgtcggggtgcacgtttgcctgtatctgtattctgattttagggtcactcttcctcttttcactcaggtaatgttccaaaaaggctctaatgctttctgttgcaaagccctggccccatgccgacggcaggaacaagtatccaagatcaaggccaatcgctcggctcgcttcgttggctactgagccgcccagcaactcctccttgattggttctgtaggcagcagtgtgaggatgccgatactttccgaaccatcatctgcaacaccatggcctgagacttctggcctagggctatgtttccggggaagtactgcatagcaaacgcgctcgtcggaacggttggccgtcgtcgaaggtatcacgcctgccatccaagcttggctagccgtcttgttttcgcatgggccatggagactgtttgagagatcagagaaagaacaagacggcacgggagctctatatacctccactgggtggcctgcttgtcacgccagacgttgtggaacaagtccaagtgcacactgccctccgcgttagaagtgagctgcattagctgtagcctcggagtttcgactatgatccccgccattgcgttccgcttgggtgttcgtagggctggagctagtgagatggatggtgttgttagtctttggagttggccgttccttcagcgtgagacaataatcactcactggcctctattttgcgcggcaggattcggttcaggtggctcacctactgacaatccactatgtggccttaataaggagttctaactttcaatattatggttgtatcgggtgttcttttatagtgattgaaacgggtgtcgccaactcgctaccggggtgccagtcttatagcggggtttggagtcacatctgtctgctcctggtaggattctgtaatcaagtctacaaacatctaggaactcatttcattcttgtagaaggcttgagttcttgttacccgaagttggcaggaatgtgacgcttcggcattgaaaagaaaatcaatagtaaaaggatgattggcagagattcaaatgagaattcaaggttagaactactaccattattcgtgtatattaatcttatcaatcgacacaaccccaggctcttgtcattctcacgaaataaaaaccaaaacgccaaactcaactatccagaattacaatgcgtcctgtgccgcgagtacgtccttaggggcaaaggttctctccaaactaccctcccagtggtcataccccacctctttcttgtactttccagtcagatctgcgttctttgggatttgatactcgctcaagatgagtttctttccagtggccttctcagtctttacccatcgcgccttctccttgttgtcggcgtcgaaatgctcccaattcttgtacctgtccccaacaaatggagcaggcgtatatcgctttccgtccttgctccagtgcttgaccctatggtaaacactggggtggatttcttcgcagaagttcttggcttcgatctcaactccgttctcggtcgccttggtttctcccggaacacgcttataggaagccgacaatgtcgacacgctcgagctgatccaccaaattgataaccacgggtttgtatcctcgagagtgccgtcactccattggacctttgaccaggctgccgccatgtctcggaccttggtgttggtcgtgacgaagttgttgtcactgaggcggaagaggatatacttctggagcgcggtaccgctgacctggagtttgccgtgaatctgatcaatcatccatgaaaaggcgatctcgtcgacgctgttggtgtcgatgttgctcgcgctgtgaccgccaacatcggaatgatatccagggaaccagacttgcttgaggttgacattcggacaggtcgaatccttgtaccagagagttggtggaaagtttccacgagtctcatcaatggcaagcgcatggaacgcgttctcaatgcctattatttcaatcagttagacaaatcatctatcattttatcatgctgaaattagatcaagggagtctgcgacttacggggatgaagctttgtcgagtgaaatgatgtgtcgtcgccagcctggacaaaccaggtggtggcgttgatgctgcctacagtgtcccagacaccgacgaccttgattggcacgtgcatatgggaaatggtcttcagataatcgaagcgactaccatagggatacggatccctgccctgctggggcgggagagtgccgagctctccaggttcaagcttgtcttgagcccactttgtcttggaaaaggcttccttgcctcttatcttgtaggcgaggtagacatcatagaagttatccagatgaagaggggtgaggaggcctacttcgcagatgaagccagccagtgaacgcgctgtgtaggcacctctagagaagccgaaaatgaagatctcatcctcagggccccaattgtttgcgaggaagttgtaagcctcgcacacattctcggcaaggccacctccaacagcacctaaaatgggatcgtattagctagagatcaggagcagtccaatgctacagagtcaaatgtaccttggtaacccttgttgactttgccaactgcgccagtaccaacgccagactggtagtagacgatttgaggaatcttctctcgcttattgttggtgtcgctgactccaacccgagagatgacacgggatagtcttgctacattgctagcatactggtcgtttcccttgtcgatcgcgccgaaggtcccatcacagcagacaatcaggcgcttcttgatattgccctgagcgtaagtcgccgtgcaggatctgcaattctcggacatggtgggcgataattcaagtgtgagtgaggaccaggagatgcagtggaagactttcgtcaaatcggctaagttgaatcgtcagaatatcccgggcaacggctttatatgccatatatatgtcacaggtgaacttcgttagccgccaccattgagtgccggctgatcaactgacaataccgtcgtcagctccctctcagccccaaggccaaagctggtgcgggagacgctatagttccggcttgacggccaaaagtggcaaaatatcgatgaatctcattagtctgggaatagttgcaggggcctagaagctgaactctgggggtcgagcctctagtgaagcttgttttcaacactatctatctcatcctatcccttgcgagcactaagtagacgagctgtgcctcgtaatgtaacctctcgacgtgggttagtggtagattggtcgtgatcctgtgatattgataggccaccctcgctgtgggacggaccgctctagactagatgaacaaggggctcagcccatccgccgcacccgtctgagacctgtcttagacccgtcatggtgctcatgaggcctcgaactagctttactagcgacctcggccctctgaaagggccagggttggcaagctattgcccccaattcttgtgctagcctacgccagtctcaatattgtttcttttttccttcatgggtctgtctaggcgcagtcattcgtgaacgagtcctcttacaaacgtcctagccatgacaattacatcacttttacgcgggtttaggggtcccagtcgctgttttagatgcattcctggaggcgaacggcatggatgagaccaatggctaaccccatttgaggaccacgagcctagaatctcctcgatgctccgctccaaaatgggcacaacctcggacagtgcacgcatctttatccctgaccgcagatctttcaacacatcctctatcgcctatgttgcctacaaatgggttgaaggtgtacgcacaacgcgagactcacctcgacgaggaccttcctgaccaagttccggcggcattcattcgtctaaaggatgaaataatggagtttgcgagagacgaacactttgcagggacagacaaagggaagtttggggaagcttggattgttcatggtttttaaccagagtgtcagctggctactggctgaacttgaagctcgatcacaggtaaccgcgtcccaactcgctttgacctttgtcttcaattgttcatactgaccagtgtatctctatatagatcccaatttcctgtggtctatgtcatcaatctttcgagtcatttgatgagctccaacttcaccgaaaccatatccacggggtgccagaaggcaccaacccgcttccagacgcatgaatgaacgggagcggtctggaacttgtcttgaatgtatttcttcataattctgtgatgttcatcgttttgatgaacttttcattattatgctatctgcgacgggattgcgaggctcagacctctcaaattatatagtcagtgatcagtttcaaggatggaagtagcctttggtgagattatgttctaggatggtattgaattgtctaactatttttagttcttgggagatgtgacttcaaacgcgggcgtgtcaaatacatcccagttatccgctgcaaaaggattgccaaacggcaccagcgcggcaaatctcatcttatatttccctggagcgatctgcgtcccgttggcgagcaatccaagccaccagagatcctctccacggtacccagtctggcttcttgcgacgtccttggctggcagcgcgatcacctgactcgcatcatccttggaagggtcgaaagccacgcccctggcggaattgacccagctggttgcagacccgacgtacttgccctcaccaacaacgagagggtacttccattcacgctcagtccatgagccttcaaagatgtcccatcttagttgacgcgttccatgttgaagacgggcgtacgctttcacgtaatcttgagcttcgagcgagaggtcaaagctgaaggtagccttgtctttgataggagtgttggcgggaccggaagtcatcgtcgggaagcccatcccataagaaaagatgctggtaatatccttgtgtagatcagcgctgagtcctagatacgggatgcctagttcttcgttattgtctcctttgataagaaccttgccgctataaaccggaagcttagatcgatcggttacttcggggtacacgaacgaaaactcggctttcttggtttcacctggctggaccgtgaaagtccctcctgggaaggaaacgcggggcgtcaaactttgaggatcgaccataagatactcatgccaagcgacttgagggttgccccagcgacttgggtcagtgtctattgtattcatgccgccgaaagcctgttgtgtaaatgtgtatgtcacaggtgaatcgtcgttattagttatttcaacgttatggtaacggctgaaatggtgcgtatcgttgagggcaaacttggcaaaggacagcgatgtcttgtagtctagaatcttggtcgcgttgatcaggcctgtgccaacctgcgcaacaggcgcgaaaaagtcgtactcgttgcctgttaggaggccgtcgtcccacttgatggcgtcgccggacgcaataatccgcatggcgagagacttggcccattctggcccctgggttttgcggccgccgtatttgctaacgtagagagtagcgataccagcagcatatgggcacgccattgaggtgccacttagtatagcaaagccgccattgagataagtcgacaggatccggccaccaggggcagtgatgtctgatttgatgaaaagttcgttggtagggcctatcgaggtgaaggagctcgcgagaccagggaggtcagtattctccatcccggcatagtgcagatcggcacgatgtgagaagtcggccgttacattgccgccggccttgatagtatctatgattgccttcccattttctgcagatatcatcccgacgacactgtcccagattggggttgaaggggaggtcaggggttgatcgttactgtagaacagaatatgagaagcgttgaagggtaacagactgatctgcttatcggcaaaagtgcaaccgccccggcgaacaaggacgactttccctcctaggtcaggcgtactttccgggagtggtgaacatgcatcatcttccaatggctctaggcttaaagggtagatcggccagttcttgacctgtgactggtcccatggctctacggcactatatggaatccagctagagtttgcggctgctccatcgatgtatgtaatgttgaaggtttggactgcgatagtgagcggctcggctgaggcgactgcgaggacgttgggagcagctgcaccgctgtttgcagcgaaggccccaatacttcctgagttaccagcagatatggtgattaagacaccgcgttcgacaagtcggttgcccaccagagcccatggcccatctgtgtatccattcactgcaccgatagaacaggtaatgatgtccgcgccgtcatcgtaggctcgtatgaaagcatcaatgagagtgtcttcatcagtgccatcaatggtgctgaaaaccttgtatgaatagagcgtagcgtcaggagcgacaccagtgaactggttagatttgccagctacgataccggccacatgcgtgccgtggccttgctgatccaatggatcatcatctggctctttttccccagctgccggccatgttccatctccgacgagatcgtatccacccgcgaccttgaagccgctaccaaatccacctccgagctggatgaagtttagcagacgctgacagactttgaaggttcccgaacacgtacggttgggtggtcataggagacgcctgtatctacgattgcgacctgggcccctttccctgtgactccggcatcgtggattttatccacgccagtcatggcatgaatggagtagttcgtaatgatagcctcatctgttaaaacgacagaaggggtgattggcgctaattgatactttctggacggccatacttggctaacagggttgagggactgcagagagtctgaattgtcctcgtctgactccagggaacatcccctgaagacgtcgctgtcatagactttgaccactttcttaccgctaactctcgccagttcattagcggcatcagcagcattgacattctagaggatagttgttagtgttgttgttctagttgtgcagaaattgttcgtgtttcgtacctcattgaattcaacaataaaacgttttgggatactaagagtctgattattgggagcttcgtcaaggggttgatcctcagacactgaaattgccgatgcaataagggcgagccctgtgaggacataggaaagagaaaccatctcatcggtcttgctgcggaaaacagtagataccgaggacccaaccaatttcgatagtccatagtccaagaagaatctaacgatgtatatgtattttccaagaccactgagatatgtgggggagtattgataacgctaccatcctggatgatgacctataccatcaccttcctatccggctccaagatagacgctccatagagcagggggactgtgcaaaagaacctgcctgtcgaaatatccggggggcagattttcctcgtattacgtttatccggcactcaagcgcaatcttgtgaagatctaatctacaagacttagaaaagggcatatgctcgaaggaggattcctaaataactttctcaatcagtttcttcatctcgctcaacttttgtagggagtatttgcatcttatcgatcgtatgctgttatgtatctgccactcagatcacgaggaaatggtttgactgggtgctgaactgagtggtttttgtaccctggtcaggagagacgagcatgtcacctctatctttaattgaactacccaatcgggatctagtctgtgtacccttgaacaagttatggcaagtgcaagagcagtaacggtagaattcgttgaagaccctcttctagtactacttcgtccaccgagaaggaagaatcacaactcttggcgtgctgtgcaatacgaggtgaagaatgaggtgattcaaattattagccaccatctcactttttagctaaagatctcgcaatataatcacgcttaatctcaaaaagaacaatgcaatcgctttcttcttccttgtttctatgtttctgaggtagagtaagtcgacgactctgctggacctaatatcaatctttgccatctatacttgccgcagagatacacaatcgccttatactaaagctacactgggatacttactaatctgaattgattacttcagtttgaatcatagaaatacaatgatagagatcgagtttccttgacgtattgttggttctaatcgtaaacatattaagagtttttgtaacagagtactggctctcatgttaaatttcgctgaataagcgaggaaatggatagataaagattaccgacagagttcctgtttatctaggagaggagtggcaagcaggatttaaaaatacaattgacatcgcgtcgctataactaaccgtggattcgacgctaccagggaacggctcggaattcgtcctgttcatattcccagaaggtacctccttcgacttctcccttctcagattcgagcaacttcaaaatcacttcagctcccaggagtggatcctttgtgcctctgaagccgttaaagcccgttttgcaatgtccgggactaactacccagaatgtgactcctttattttgagcctggaaatgtaaagtaagcatattgagagcggccttgatcacacagtagtcgatgacagcaacggacggcagctagaatgattaacgccagttcagtcggagatttcggctaaaagaaacatacctctccgctaaccgtcttcccaaaacttccacgactgctagagaccatgattacacgaggccagttgcttttatcaaggagaggcaagaatgcacgggtaacctgagtatttgatgtgattccgttgttaaagctcttgttcgaggcctggcgccgctctgctgcatttacggaggaggagagttctattttgatggcattgttgatgagaactttttcgatcatcatttagccataccctaccaactcgtttgatgtttcagcttaccatcaagatgaccaaaacgttcacgcacgacgtctgcggctgcgactattgaagaatcgtcctcaatatcgagtgcgagtgcgtgaaggttggccgaaactccacttgactttagttgctcaatagcatcctccccagctttaagtgtgcgacagccaagaagaagggtgctatctggcagccgatttccgatagcctggacgatggcgtagccaatgccccgattggcgcctgtaacaaggatcgttgccattgtattagaaattagtcgataatataaatgaagactggagttgatgagtgaattgaaatccttctcgacgccagcacttggacatcctcataatatttagttccagaggaaagatgtcatttataaacatacatttgggaatacttaaggacgtaggcaagcaagattgtgcttaactccgagcagccctcctggattcgatagcttcatctcacataccggcaagatatcggcaagatttcaagtagcccctctatcaagccgcttacattccgttaagtccgtctacaaccccgccattagcccagctgatctgtctggcgctggcataataacctttcgtaattgtctgaacatgattgggaactcttaattccgaatgaaagaaattagagactacaaagcagttattgcaattttccacaaggactgaacgaaaaatcgatcataccaagtgatagataactactcggttaacttgtcaaatttgagcgttgatcagataagtactatagttagaataaatctaatcatttcctgcaactcagcacggcgcagcaaattttagctcccccagaagagctgcaaccagtgggttagtaacttcgacaacgctggcaggtgacttcacccgtcaatgagttaccggagctttccagactactgcagcctcctttactatctaatcaattttcaagaaatactcaggaaaatttggcgacgtattagtcaaaatttggtatttctatggagttccgtggcaggtgtgctacatcgccgcaatgaccttgactgatatccagaacctggtttctctatgttcagatacaaaattgacagcttagaaatggctatcctggctttaagactaacacttgcatcacgtgtaaacactcttctcattgaggggccgccaatgatactgagctaagtttacattttgggctcagcgattttgtgaagtagaagttgtgctaatgtccccgaagcccccccaagtcttccaccacaatgctaattcaccagttttccttctatctaagacttaattattgcaaatacaaccgtcctattcctctttttgtaatatctatgtgccttaccccctggataattatgcaaaagttagctagctcgcttcgaagcgcttcgcttgatagtagagccctcaactgaggcactctgtggcaactgcgcctgcaaccaaggctgctctcttattgaactgtccagatccggtgtctccctaagccttgactgcctatcctcggtcacaatatcaacctggactgatttgtggatgcggactctgctcccaggtgacccgccatcgctcgtccgcgttgtctgcatatcctcaagcctaatgctgttactttttccgccgttattctccgcaaccatgcgctcttcgctctcgttgagggtaaagtttgtgatcgggttggccgtcgggggcccgcgacctcgccagcttggcccgctactaccaccgccaccaaatgtccggaaacccttgggagcggagtttgaactgtagttcgatgacttccgtgccgtactgaccagtgtgtcaatgacaggcccaaaccagactttgagaagtggaaagatatgcggcaggttggttgtgacgagggcaacgaacgtttcgcggacggcccacgagccggcaagttgggcgccattgacaggatcctaatttagttgaccaattagcatatatggattctgaatggatcttgaactgttggagttcaagccccaggtcgtaaagtggtcttacggtaacaatgataacggctcgtagagttccacaaaccatgacaaagataccaccgctgaatagaaagaccagcccaaatttcttccaggtctttaatctagaactccaaagcatgggtagtgggatagaaagaagatacatatcggtcgtgacgttgaaggcgtaacacacccacacaatctggttcgacacggccggttggcagacatctagtaattgatcggcgagtcagcacttctcttcttaaacaatcttcatttttttaaacagccagatatgcgccaaacatagatacgtacttccagggtcggggttgatctgccagtttcggtgaaatggtcggcaggcaagaaaaatgttgacgacgacaatcacccagctgccaacaactagaccaaagccaacatatatgcgatatagatagcttttacctatcccatcctacacaattccattgcgatcagtatcaacgctcgtccgagggagatggaggtgaagtaaaggggcaagcgccaagtcgtcggggtcaagtaccgtcagtcgaatgtaaaataccagccacgaagctttgaaagcccacaaaataaccgaatatgagttccaaccgcatagctggataatcgagccgataactcgtagtttatgctcggggtcgtcggtcgatagagcctccctttgggcgtcggtcattccattgttggctaagccgtgggcatgagcgcctacagaatacgcaagtccgctctcgataccgtaaaatatctatttccacgaggcgtcagaaagagatagatcttctcttcatgagacgtccgtttgtaaaagaggaaagtctttcgtcgtgcgaaaataacggaagagcagacataccagtcccacgatgaccagataatcgtcaggctgaagcttgcgaaatccgacagatcttgtgcgagcgacgattctcaaaaaggtgaccaatgacccaatccccagcagagtccaaacttcgatgttgaatgcctgggctgctgcggctgctgctgcggcggcggcagcggcctcctcaggagttagctcagctgcggcgctggccattggtgaatggataaaatattatacaatgcaagttgattaggtaaatatattgttactgcggaacatgctgcaaaataggtgcaaaggaatgtggaaaagatgaaagaaaggcgaacgcgatattcgcgcattcgatggacagcgagtcacggagaacgtcacatcaggccaggcacctggaaatgagagaaacaaacaaaagtttcattatcagattccccccgcagattcggcacatacgagtggcccgattcttcattgtcgacatcaaacaagagatctgccgttcccaccatccactgccaatacgagcatcagaagaactgggaccaaggttagggtacctcttctctcatttcggggacggactggctacctttttgaggctttttatccattcttttccatttttatttgcttttttcccttgtcccgttctgttttcgacggagaaaagatgttggtgctatcaaccatgcttacatgcagacatgacatacgacccgcgtctggttcgcaacaccaagtctttttgtggatcttgttggccaaacagatggttccatttgtctcgaatttcggctgtgactggagcttgcaaatgcatgtggcctcccgcagaggggcgaagcaccgagggtgaataacactcgctccgcacacccacatgctgtagtaatagagttacgtattcatcctcctacacaatacctccggcaagcgaaagccgagccacgaccatgtacacaatatagtaccgatcggggccgagactaaaattcagccaaggaggaacaatggggacgatcctccggcacggctggttagagtgaaatggcgccacatgtaagaaccacctcccagagaagatgtgatgaagcacgaccctggcttccggcgggccaggatgaattggagtagacaggggctggggtacggatagatctcaacgaacctggtgagaggggactcccctcaggggaggcctcaatctgcgtaaaacacgcggctttccagagtggaaggtgcggagaaacgcgggggcgtggagatagaaacgaagtcacagaaagacagtgtcggctatgaaacgatgtagacggaggtccgtcgaagaacaatacaatgatggtggatgggtttgaatacacacacattcttcaatacagccaccatgcgaccaacatccgctagcgaaattcaataacggctattgatgcacctttttgtattccgggtaggggagggtgacatcgctcgaggcgtgtactttaaccttccgctaaatccggcattgtctcaggcaatcctacacaattgcatatctggcacctcctttttttttggtgccctcatttcttcaaacacctgccaaaagtctaggagttattagcacagggactcgggcgtttgagagagagttcgatcgaactcttggattgattagagagagaacgaactactctcatgaactcaagagtaagatcagagaggacatagagaaaacacatgcagggaccaggaccctgtgctttgccacaccaattgctcacagttgctcaatcagcagacccctgtagttacctgaaccaacaactagacctttggtaatgctacgagctgcattcatccccgcctgttggtccacctgttggtgagatacatagtactaccgctatgcagccattgccggttgcctgcaggtggaaggtctctttgatcgctttctcccttgcttccctgcagtctcaccccttggagccgatatgcggccgcagcacggcaagatggttcgatctacaggcaaggcgctcccacagctgagcgcacgaacactcccacgcgccactctcgttgtaccactcttggcaaacaaagctagctctgaggtcatctgtgacaccttattggggccagttcccctcgcctctgaacaccagctagacttgtgtttgttccctccattcactagctaaggacataattgaacagattgagatggagaagtttgattgtgtttctgtcggtgcaggtgagctcgaccaattaccccatcttggccaaattcacatgtccatcccatatggttgatgcactctccagaatggcgggcgcattgcggccacaatgtgatcgaactcgctgctgacgactgccatctgcaggctactatggcctcgccgccgcgaaacagtaccatgtgctcaacccggagaagactctggccattttcgagggcgagtcgagcatcggaggcacctgggcagaccaccgaatctacccaggcgtcaaaagcaataacctcctcggcacctacgaattccccgagttccccatgaccaccgagcgtttcggcgtcaagaaggacgagcacatacccggcagcgtgctcaacacgtacctgaaggcctacgctgcagactttggcatcgacaagttcatgcgattcaatagcaagattgtagtggcggagcaccaagaagaaggcggctggatcctgacggtcgccgactcgaaggccggcaaggagtaccaggtgtttgcgcgccgtttgatcatggccagcggccttacctcagaggctttcctcccacactttgatggcgaggagacgttcggaggccgcatcttccacgggaaggacttccagaagaacaaggacaccatagagaagggcaagaccgtgacggtgtttggcggaacgaaattcgcctttgatgccgtgtatgcctacgcgagtgctggagtcaaggtacattgggtgatccgctgtaagttctgtctctgcccttccaattgattcgagatttatgtactgacctgtcgatcagcctctggccatgggccatgctggatgtcgcctccatacgttacaccattccatcaatggatcgaagcacttgctcgtaagtattatccatggagctgcaattcatgcacaatgtcactgacaatcggcgtccctgcgcacgacagacactcgaatcctcacttggttcagcccttccatctggggcagcgccgacggctacacaggaattcgcaactttctccacggcactgctttgggccgggcaattgtgaacgggttttgggcagtcctgggcaatgatgtccttcgcctgaacaaatatgatgaacaccccgacactgccaagctgaagccctggacatcagccatgttcacgggccccagttttagtattgtgaactgggagaccaatttctgggatctcgtgaagagcgatctggtcaatgtttatatcagtgacatcgatcatctcagccccggaaaggttcatctttctgacgggactgagctcgagtgtgactctatgctcgctcacactggctggaagcatgtgccagccaccaagttccttcctgagggcatcgagaaggagattggcatcccacacgcgccgccccacggccaatcagaagaggatcttgcgagccaaactaatctgcttaaaaaggccgatgccgaaatcctggagcgatttccccgtctcaaggaccagcctgtctggaataagaactatatccccttgactgagcagaagggagtgcacagcgacgatgcagtcaccccttgcaagcctctcacaccttatatgctttaccgtttcattgttccaccctccgagcgctttcttaagacgagagaccttgcctttgccggcgtggtatccaactttggaaaccccatgtccgcccacttccaggggctctggatcagcgcgtacttcaacggccagcttgatattgacccggccaaggcagtcggcgacgagaagctgatgagcgagctcaagtaccagaccatcttgcacaaccgtttcggcaagtggcgctaccctaccgactggggtagcaataaggctcctgggttcatctttgacgcgattccgtatctcgaccttttacagggtgatcttggcctcaacaagtggcggaagggaggctgggcggagatcttccaggcatatgaccccagagattatgctgacgccaatgacgaatggaagaggaaacactctcagaaggacgatggagcatcaacaactgagatactttaactgtctaactattcccaaggtagatggttattatgtagtattcttgtttccttatcttgtgggaggctgtattataggaatttatgattatttccagaaaataacagaaaagccaatgggtattgccatcgtttttaacttgagtccacaatgagcgtatcggccattacggataatgtttccatcactatgtccattttaccaaacatttcagacaggctttcattagtgcttcacactttacggccctttcaagcaaacacgtcctctcgaatcctattctcgtatctgtgtcagtcgttcgtaacataacttcgccacaactgcttctccatccctctaagcacctgacaaaattgttcgttttaaccattctgtgagcctacaatcggtcctaggaaaggtatcgctagtgaaccttgatcacatatctgagccagaaacgggatggcataagcgtgggtcatatgattcaatcagactattgataacactcccgggccggatagcttgtcatgcaggtaaatttgtgaatggcaagtagaatgtagatccccccctccattgattaaccatggattgacataataaccacggattccaacctcaccttacggcttctttcacgcccatacctatctatctatactctcacatcatttcatggcttctccgaaataattttaaccatgcatcaatctccccctcccatccagggccctactaccgactctttctggcgttcatcttcacactccctggacggccacagaacttccccagatatccccccggaagttgaaatatgtgtcataggagcaggatttgcaggtgcttcaatcgttcatcatatcctggacatctgcaactctcaaggccaaccgcgaccccgcattttgattcttgaagcccggcaagcctgctcgggagctactggccgaaatggtatgccccctccccaattaccatttgcgctcatacgcttgaagcctggcaaatgtctcatcaacaacgtattatcacaggtggccatatcaagccggacccttgccaccggccatcgagcctggctatggcctatgggatcaaggttgccgccgagtgcgcagctttcgaggcccagaacctatccgccgtgaagaaattcgtagaggacgaagccattgattgcgagttcaccctcacgcgggccgttgacgccttcatgtccgatgctgtttgcgacaaggtgatggccagtgtggatatgcttagacgaaatcatgtgccagtcatgtcggacgtgcatttcgcaaagggctccgatgcggaagtggtaagataggtcattcttctggtccccgtaattatttgctgacctggagcagctatctggagtcaaaggagtcaagggttgcatttcgtattccgcgggacatctgttcccgtacaagctgaccttacaccttctctctaaagccgttgatgctggtataaacctccagacgcacactcccgtcctcagcgtggcggaacagcctgatgcggatgggttcatcacagttactacgtcacgagggagcgtgaaggccaggaacgtagtttatgcaacaaatgcctacacttcgtcactcttgcccgagtttgcgggcaagattattcccgtgagagggatgtgtagccatatctcgcccaccaagaaaccagctcctcacttgccaagcacatacattatccgctggtccgatacaaattatgattatttgatccctagacttgacggcagcattatcctcgggggagcacggtcgatcttctatcatgacctcgacagctggtacaacaacgtcgacgatggccagttgattgaagccgggaagtctcacttcgacggctacatgcagcgagttttccacggatgggaagacagcggtgcttatacctctaagctgtggacaggcagtaagtgattattttgtgtcatattaagaagtagataaagctaatgaaattgactgaacagttatgggttattcatctgatttgatgccttttattggcgctgttccagggaagaaacaacagttcatcgtcgctggattcacaggccatggcatgccccagatatttttagccgcaaaaggcgtcgcctcgatgatcatcgataatgtggacttccaaagcacaggaatccccgcggtttatgaagtgactcgctccaggctagacagcaagcaaaactctgtaatagagagctgggagacggaacatgggtctgctgcaaccttcagcaagctttagtctaaagtcgttgtttaatatcgattgattgtatgatgtttcttctatctgtcttatcaggaagactatggaaaccccccatccaactcgaatcaaccttcccacagtgtaagatcaacaaaggtcaaagccgcccacaggacctactatcgaaacatataattgctaccacataacggattgaagggcactagagacggtcaaagcgaagcaaaataatgattttaagcggcgaaccacaacatagatgtaataaataggccacacgatcaactacctctaagcgaaacccatttgttctatgatatgctgatctaaatgtatctcgaaaattgtcgcttttggattcaagcagcaactgttggccagtcgttgtaaccctgctctggcgaagtataagggccatacaggacagtgtcgccccgatcattctgagcaaggggaattccatacttgatacgggtaacaaggtcctattttacattagctgatgggttagaaagagcaaaggacaaactaacaggattccaaatgaaaggacggccaaatgtgatcaagtcgagtttgccctccttgacaagtcgatctgcttcctcaacagtgtactcgtggttggccatgagcaaagaagggctccctgggtatttaaccaaagggccaaaatccagaaccgggtcatagccaagtggcagtggataaccgtcaggccgagggaagcttcgagtgaacgaaccatcgcccacggttagatcggtacctcggcgtgatatgttgataattccaaccttccttgcaaccaattccttgattaaataatcataggtttccttcaggtctgcaaatgtcatgactgttccgtgtagaacatcagtagggttgatcttgacgcaaataagttcatagccaccccagacatcgccgatagcatcgacaacttccagcaagaaacggcatctgttttctactgggccaccataatcgtctgtgcgcgtgttggcctcactacgttgtattcatcagcgttttaactttttcgatgcgcatctcttttcgaagactcacggcactagaaattgttgaaccaagtagccgctatttgattaattagcttcaatgccatattaacaagatcagacgatccggagatggtcatacccttgagcgagaagttcaatgccatcaaagccagcacgtttagcaagtgctaccgcgcgtcgaaacatgttgacgatctcagacggattctcgatctctttcaaattcgcagtgtgtccctgttcagtctatattaacattattccttcaatcgtcgtgcgacacttatacttacgggaactccaggcaggtcgcggtactttccgcctgaggcctggaggggcgatgcagccagaacgggaagatctctctctttaagagccggcatcaggtcattctggcagcgacctaccgcaagtttagtgagatttccatactttcaggaggtatttgtcttaccagcatgccagggttggaagaacatcttgccgcctgcttgatggactccatccacgactttctgccaagccttgcaatggtcctcagatatcataacaggggcgttggtccaatgagatccggtccagtcaataaaaactccctcgctaatgatgagaccagttccatcttttgccctctgagaatagtggtcgatctgagcttgacccggcttcatatcatcgacacacctgtttcgagtcaaagcacccatgacgactcggttccgcagtgcaagcataccgccaatggcaatgggctccaaaagacttgacattgtaagattttgtgtggtgatcaggacaggttgtgatccggtggctgtaagtgttgtatatgatccttctactaaaacgtgggattcaacagggcgagctatctttatatatccagattccacctcattaagcgcctttcttcgtcagccatatctcttattctatcgtatcaaaagcctgtcatcgtcatcagatggagcaataacagcacaggtgcggcggacaaggctttccgcggggccgcaaccaatccgatgccgccattcccgatccttgttcaaacagctcaaagtgggctttagccacaatccgcccgatggagagtaaaagcggatacggaacatcgccgaccatggcgtgttgttaggcgttgctaattgctaaaccagattctgctgacaaattgttcaacatggaatgtccaacaactgaaccagggttatcctctgctggcttgtgcttgtagaactggctctatacttggttgaggcatttcaagctggcatgcgaccatgaagtaccccaagtcttgccgccaatgtcggcagtccaagcgcaagtgcacccgcaagggtcctggagagccctgcgatacatgccaacagcgccggttgagatgtgacggccagatgaggagccgctcgacagccaatgcacccttgaccccttctgttccctggaaagatccccgatcgtttcgcacacagagccattctgaagaggagactctctctggcctttctcgcggaatcattgtggagctcgtgggacattacctgagggccattcacgacaaatcccacagcctattccatccacccacgttgtactctcaggtccaggatggctccaccgggaaggccctcctatatgcaatttgtgccattggatccaagttctccggcaatcctgatgcaagggcattgggtccttgtctagcagccaagtctaagcagctattactagcggatcttgagaatatttgtcttgaaaatcttcaaacttgcatattggttgcaacactatgtgccggtaattgtaccagaggcactgaagccctgtttttgcgtgagaattcaccctcttctcgcgaaatcagaactcctactaacctccaggaggtattgctcactccatggccgatatcatagacctcgacactccaactccaggagacaccattattgtcagtgagtgcaagcgacgaacctggtggtcattattctactcagatcggtggtgcgtatacggcctcggtctcccatgtcagatgcgggatcctcactcaacactctcattaccgatggatgagaaaatatttcacaatctgagtcctgacaccgacatcctggatggtccctggcaacccggtctatgggctcagaaattagcgctcgtccgattttttatcccaatacttgagctgaaccggcttgctgcaaagcataaaacttccactgcggagtgcgagctgggggttgagactttagcccaaaagctcaagaattgggaagactctctgcccgaatacgctcagatgaaccttgggaatctccataggcagcaagaaaagggatttggaggagtacttctcactctacatctcgtataccaccactattcgatactgctcttcttccgctttctggaggaccagaaaactgacagtaccgtcagccgagcatatgccgctcgttgtaaatctcacgccactatgttcaactctcttctccgtcaatcccgacaactgaaggcatgcgaggccgtataccctgtagtcggccatatggtgacagtggcttcagcagtcctgctgcacacccttttgttcggtgacttggaggagagtcgagccgcgagacaggaactagaggagaatttcgaagcccttctcgagttaacacaatactggccatcggtgtctaaaatggtatttcctacaccaagtccttggggtcaaatatccctcacatagtcagacgctaactccaaacgaagataaaacgcttgactaggttccagaacatgtgcctcctttcaactgattctcgtccccatcagttagatggatggatggtaaggtttttgattgagcgcgcgatatctcttaccgataggcatctggacagtacaccaaccgtgcctgagttggaatcagaacttatatcatctaaagcaagagagttttcacagcttgggagatttatgaatttcaaaaattcgtaatattggatttttctagtcccgactgtagggaatgcacccgctatacgccagcaggtagccggacagcctgtagatgaatgacaactagccacttaagaatcatgaccagacgcgaagccatacaaggcgtattcttgtattagaaatattcatcatggggcaaggcaaagaagttcagttaaaaccaaagttactggggaatcattgtaatcatagccaggtgggtttgcccctgcaatcgaggatttgatgggagacatttgctcaagggctgagcattgtggctggaggaggaatagggcaattcattatggtaagtttttgcaacgccacacatcaagaacctcgaagtcgtctagttggtttatggcgccagactgtaatcgcattgaaagcatatctggatgtcagcggttcgactccgctcttcgagatttctttttttgattttttggtcaactttttattcctgctcaactattccatcaccaacgataatttttttttatcttttggtacagatcaaaaaagcaaacctaggcaataaatcagactctggagaccaaagcatcccggagataagttttcccatgcgcaacattccagtggctggttagagttaccctatacccaaaatattatctttacaaatttcaacattttatcatcgcagcttgatggcttcacgtgagcttaataagtatccggcatcgactaattcttgacatgaaagttaaaagaatgtgaacgctggttcgccatacctcgacatgacaatttgttcaaagttggattaccataactagtcgccagggaccatacagagtgcggctgtgagattttatctccacattgcaagtcatctctacacgcacacgagatactgaaaatgatgataccattatgaacatgataagagaaaatgtacttcaatcacttgatgcatacatgtcattagatatagggtaggttgaattaatagagcgtcggattgacaaggggcgagctattaataaggtccttgccagaggcacgatgtggctgaccgtaattaaggccctcaaaagtagttaaactgccatggacctgagtgcaagccaacgtgagccggatttttgatgtcaaattgacacgacacgagggaatcgacatgcccttcactttttggtgcttaggggctcaattgcactctcatcgttgagctactgtgacttgtcaattgagtcgtttaattgtcatgttctctcttttgcaacggcttgtgccgctcgttcacgagatgttcttcctagaagggtagagtcaatatgctgtggctgatggtatgccggcttattaaatattgagtctcgaggggaccgagctgactcagtggatcattgtcctgtctcggtcggagtcgcaggtgtaaatgtgggtgtaggatcgggacttggggagccaggaggccaatcaccatcgctacaaaaatagccggatcgccagacccctgctgataccgcaaactgaaggaacctgcgctcgtcagcgcacccggagtcggttcctggcctgtccttcacgctcaaaacaccgtgggatatataagatggcaggccacgcatctcacctgttggatttgccacttcttctcttctccaacctttttccacttttctttttcgccctttttgttttcggttcatcttttgtgtttcttttgtcttgtgttgtcttgtgttcctgtcccgtagccctgtcattcatccatttcttttctctcacttctttcaccgggaacatccacaggatcatggaatatccctggctcagaatcgccactggattggtgtttatttttctgggcatttccatctacattgctgtgcttgccagccgaagactttactataagccctatggaatccgcgctggcgtgtggtggctcaaggtgtcggcagcactagtgatactgtgagcaacgactttcctacatgacgaaactcgactgctaacattctccagatggcaggctctttgggttctggtgcccctctcggagatgcggcccttcgtctccatgtttcacctcgcattcacggggcatctcatggctttgagcgaactattatcgggctttagctactccaccgttctcttctcccagcttgttcttgcctggggattcaagacgaaccaggccagcaacaacaagttgaggcgatgccttgcttgggcattttgcctggccatgggcagcttgatcgtgatgcgcttcgtcatcgttgagctgcttgcccgtagatcatggtcaacagacttccctcacttgagtttcatgattgccgagggatccatctatgccgtgctgccgacatggctgatcagcagccttctgttgatggcagccggaggtggcttggtttactgggtcaacaccagaccagcacgcgccactcaggtatgctcctcttctctgatatatcttgggagtagcgaaactgactcattttgaaataggcttctcgactgatgacggctgtccacagcctcagcttcattcgtcacctctacgaaaccatttgccagtttgtcgaaccgaccgagggcccaatcgatatccttagcatgggctccaggaccttccggctggttccaaacacaatatttatcaatgggacaatggtggcttgcctatgtctcatctatcgcatcgctttccagtacagcgacgatcttcaagaggagtggcggcaaagtaaagagtacagccatgactccgagtctgaggatattgttgccttttaacggcgcaattctcaaccaatttctttcttttctctacttcgatttggacacgggattgatccaatgatttatatcttcttcttctccttttcttctttctattctcttttctcttttcttttccacctcacttttatgaccttttcttcttcttcttcttcaagctgcatttgtatatatttatccttctggaatggcataagatgccgcagcattttatagatgaccaaattgagacacaagatctccttttcatgtttattttgcatcttctctatgaccccccaatgtatcttgagtgtatcatattttcacacagtgaaaggctgtaaataattgggcataactcgtcaccgagtttagtgacgggcaattggagaggcagtctgtgactctgtagcactttccagtcaatggctcacgatttggcagtcatgacacgcatttcgaggctcagcccagatcatggatgcattcatacagtgcaacacgcgtcgcggtgacatctcattaccgttcccagacattccaaacccggatgatccgcataaagacgaacccttaattaacccctcattataaaccacctgacacgatcaccggacccatcggaacaagctagctgcagctcccccttccttctttattccatcgcggggttccaacggctggagtagactggagtcaatcgtggagagactgatatcacataccaacagtaaacgtcgctaaaaatgtccaacaaggtcatcgcgcacatcgacaccccggatccctggatggtccaggccaatggagtctactacctcaccttcaccctggccaaccgcatcgagatatgggagtcgccgctgatggaggacttcttcaacgcccgcaaggccctcgtctggcagcccgagcccggctcgcgctgggccgccgacatctgggcgcccgagctgcacctcatcaagggcgtctggtacatctacgccacggcctcgcagcccggcgtgggcaacccgggccaccgcaccatcgtcctgcggtcggcgcgccaggaccccatggaggaggcggcgtgggagttcctcggcccgctcaagggcatgcccgaggcgttcagcatcgacgcgaccgtcttcagccccaacggcgaggacctgtacatctgctggtccgggtggccggtcggcgacaactcggacaccaagcaggacctctacgtgacccagatgatctcgcccgaggaggtcgtggactcgtcgatcctcccgccggcgtgcatcgcgtgtgccgacctgccctgggagcggttcgacggcgggaggcgcgggatcaacgagggtccgacgtggctcaacctgcccaacggcgcgttcacggggatcgtgttctcgggacacgccagcttcacgagcgagtacaagctggggttgctgcggctggttgcgccgaacgctgatcccctggatccaaagtcgtgggagaagaggccggtgccgctgctgatgaacgacaagtcgatgcctggaccgtatgcgcccggccacgccagcttcctgctcagctccgaaccgggagacgacaaggtgttctgcatctaccacgcgacggacaactggggcgagggctttgccaaccgcaaggcccgcgtgatggtgatgggacccgagcactttgcgccggatgcacagccaatctgctgctccaaggcacccgacaatcctttctggagaggaggtgctgccgttgatgctcctcagagtacgctctcgaggagatccacggcgaggcagaagattgatgaatttgctagtaaggcgcctggtcccgtgaagaaggcgttggataaggtgcaaaagtttttttaacagaaaatgctgcgattaggcctgagcatcgtgcttcatatatcttccgacgacgattttcagatcggtcgctccatgtcttcttcttcctgacgtctgacgccgcgatcgttcgagttttgggatcggaatcaattatgaagcgacgatgatttattgataaatgaggcaaaagagaatttgcaaattttgcgactgtatgatatcgacggaattctgaatcgaagctacctacctataatcaccggacttgtgcattggaattggtgctggtgatgatgaaggaggtggagaatcttaatcgagcgctagagtgtcgaatgtttctgagattgtagattttctctcgtgtaagggcctttgatgaatctcgagactggatgaatatcacagcaatcagtttattgttcggtttagatatagcgagctgttcgtgatggttctagctataatcctgaggtacagcttcatacgggaacattgaagataagataacccctgttcagcggacccaagacaacgaattactggaaatacagcgcttgtagcgggatctgccgccgaagatccccctaaagaagccattgaccaccctgaaggccactaaatccctcctgcagaggcttgaggcttccgtctgctcagcaaaacaaacatccatcaaatggctcccagccaacccgcggatcccaacgagccactcgtcgcgcttgtctctgtctacgaccggtgcaaggatatcctgaggtcggtcggccatgaatggtgcctgaataactacgatcaaaaggccctccaggcgcgcatctcgacggagcaccagcggctcgagcaatggggccatggcatagggctcgacgggcccaagaagttccagctgtcctccagctcggatggctatctcctgaaccacgatttccatgagagcacccaaggcattctcgaatccatcgtgagcattttcgaagagaccatcgcaaacttggtacagcactacgagctggctccctcttcctccgcacctacgaccggctctgcgcgtggcggatatcttgcccgcatccagtcgtttctcgctgctaaaaatcccacgtcgcgatggcagcgtcaggacaaagttcgctttgtggcgtttgccgaaacggtccatcatcacgttggggttctgctgcagaagttggactactttgagagcgtcgccaatgtctgaagcggcaaaacgctcgattttgccccaggaaggttcccagttcaagacctggtgtattatgttgatgctcatgtaggaatgaatatacccattcaagtttccaaacgaactggctgaatatcagctataagggtttatttagttactctatgtttaagaccgcaatactgaaagtcatgtcgctagatatgataagatagggttgttatgcgcaataacaaagttctccctaagatattaggccttcaccgcgctgacggcctgaaacatgttcccaagatcctcggctgtcttggcctttgcaggcttctggaacccttccttgtacgggatgcgctcgtgctctgccgaaatgttagtaaaacccccaatcagacgaaagcgacagatgccgtgagcttggaggtgagcttggagacctaccgaaaaacgtcttgacccatgtcttgggagcaccgttcctcgcaccatcccacagagtaagaagatacaaggctgttgtgccgagtgttactgtagactgcagctgggaggcatcgaagtccttgttcgccgcctttgccacgacctgccgagcggcgtgtgctttcgccgcggtctcgacggtcacgatcttgtcgcccttgcagatgcggttgagcccaagattctcggccacggcgtcccagatttcttggttgtagtggaggttatcgccgagagccaggtcactgcgggaaagcgagccgtcgacttcgacaatgccgtgcgccttgggcgagactagatcatctaggttgaatgtggagttgggagtgtttgttgtagagatgccgtttcccaaaacatccgccacggccgagtcgaagacgccgggagcaaagttgaaagctgcgccggttgcgtagcgaatgtgttcgagggttatttctttcccggatcgagggaggaatccgtggttcgccatcacattcaagcccgggcatggggatcggcctgggacaaattgtaagtacatgctgtagcgttgaagtggaactgaacacccacgatcgtcgcctttaggaacctgatattcatggtctcttggctctgaataatgcggccaagcggtagccgctgtgtataggatggtactggcgaagagtgagagctgcatgattctaatgaggctgttgtgttttgtattgaaaatacggaggaagtatgatgccaaagattcggagctccaacacctctatatattatatactcctccattttagatagggctaccattatgacgatgtaagataattccgcctgtcttctgtgcctcagggaataggcccaatggtgaggcgcgggatcatcgcagtttgaagcgtaatacgcaatacgctatacgcaaaaacatccccacttccaagaaattagaactattcacagcctcatcccggaagtatttcatttgtctcttaggcatttaattaataattcatgcatactattggcttagcgatcggctgcgactttctggacacaaaatcgaagcgagtctgacaggcatcacagtactatgatcacatcttcagctccatgtgggcaaacagaagagatgaccctaatgaagatggaagcttgctccgccaatgtctgagcctctgtggcctagacccttggtttgaaaaagcaatggcaggtcagaatacgcatctacagtcgtatcattgaccgccctttcttccaccattttctaggctcactggtgtgtgccactactgatttgggtcattgggctgagagtgggattggggtaaagtatgatgaacagagcttcaatactacttcttcactctctctcgatattacctggctacattacacagaccaactgaaatcagccagcacgggattgtggtctgagacaatatttccatctggctgcttaaacacgtcggatttataactgaaagagttcgcagtcaacttgaccgagtcgccggagcgaaaactatgaagacaacacgtcagactgggccaaatatacatggcctcatttgccaaggcgagatgttcagacttacagtatcttatcgacgacttcgcaattgttattaggtgcaggatttgagcagtagttggcggcagaaccaggggtagggtaaacgccgcccttgacaacagtcgcccagacatcgctgaacccagccgagacgtatttgttaatgctcaagtccgacgtataccagcgatcgttcaagtcacccgcaacaatcacggctcgcccagccgagttgctgttgatataagcgaggagctggtcaacgcccaggctccgggccaacttgtctccccagtcatcactatccctcgcaagtcagaatctcgtttcagggaatggtcaatttcagaactcaccctgcgtcggcatgggcgttgtagaggtcaatctcggctccgccaacattgatgcgcatgaaggtgaatcccttgggggtgaggcaatcagcctcattgacccaacagaacttccaggtgacgcggtccagaccagtccactggaagttggagagcgtattcaagccagaccccgcaataacattgcccgaggtcaccgtccggtagggatggttgtccttggcatatatctcggagttgtagccgaaatcttcctgtatgtggatgatatcgtatgctgtctcggcaaagagactgccaatagtaccggcattggtggccttgtcccccggcacgccgttgtcactcagccagtcagggagaccagctacgttgaaggtcaagaggctgaaggacccagatgattgggcgattgcaaccctagcgagacatgaggtcagggcaatcacagagctggtataataacgcatggtgactgacagttgtctgagtaaaggactgatgcgtcatctagaaagtgaggatgcatgcatttgttggaggtgggagtcttatatatattaatgcaggaaatgatccgcgtcatcccaatgataccctcccttttcagaccagtcgtgacctggctcgatagaaagagtcgagcgccagcaatgctggttggcaccacgctcgtcgtgctggacgacgattggatgttcccaactggccttcctatttcgtccaccaccgacatgcaagtgatgtcggcaatgaatcttttaggttatctgctaccttccccgcacggaaatcatgcattgattggaaagaatccttgtaaataactttaattactgtcacgttgtcaaatctgatgcccaactggattagcaccattacacctccacgcagtagattaacgttatacctagtattacacataatcctttatatcgagtggcagtgggccttctggaataattattgcgatgaaatatatatatcagaggtatggtgacgacattaaagataggtatttagaagaaagagatatcactaagttgtatcggggtctctttacatttgaagctaatagttctaattcggtatcctggccctggttaagccctaagcaatgagcaatatgaacctgtgtgttaccgaggtgcagcacctattcctcagttgcgtgtctcttagccgtcaggctttcaacaggcgcatcgacaacgtagttcatagtgttacgcagatcacccaagaagaagcacgcaagacacgcggcggcaccgaaggagattgcaatatagtagacaacatgcagcgactccgcgtacgcctgactcattgccgatgccgcggcttcaacaacagtagagttgactcccggaatagcagatagtgctccggtgtcctgggctgtgaaagcgctgacgaaggccgggacatggtcggtcgccaagcctaccttagtcgcggcttcggctatcttagcatagagcttgacctggagttcggagctgtatgccgcgctgaagacgctcgtgaagacggttgcaccgaccgcgcgggcggaagtagtgacggctgtagcggtggcaatcaggtggtggggtgtagagagctggacgcccgtcacgacgaggacgaggggggcgccaaagccgagaccggcgaggccagcaaatatgagacagttgagatcatctccgggtcggacggtggcgaagccaacaagtccagccgtgaagatcaagaaacctgcgaatagcggactgcggatggttcggaaccgcatgctccagtagccccaaccaacggtagacagacccgagacaacccagaatggtagtccacggacggtgaggaggaatggatcttgttcgaataatattgcagtcctgttgtgccttgttagattgctttccacccgaggagatgatggatgacggggaggccagtgtccttgtacttacatgactggataaaagataacataagagaacagcatgatgccttcaatcatcatgagcacgatgcaaattgcaaaagtacggccacccgccttgcctccccggaatagttcatgatgcaggatacctgtcttcgtgcccttccactcatagactccgaagccaactagagttaccagcccgatgaccagcaaagacaggactcgggcattggtccacgggaagagcccccctccgaggttgagcgcgacaagtaatagggtgatgccggctgtgagcagaccaaatcctggtaggtccaggtgtccgagtttctgccaaagggacaagtgatcgagctgggtatgtctctttgggggtcgatagccaaagaaaataccgatggctgtcatgccccagagggccatttgtacccactgttgaacctttagcttgttgctcttgagcaggctttttaagaatttaggcaatcttacatagaaattcttccatccgtccttcacatctgcttttgcaaacgcaccgatgaccagtgggccaaccaccgcgccaagacaagcggcgatattcataactgcttgagacactgtgatcggagagttagtttcgagactcctcgtgagcatagagggggtcgaggcagagggttttgacatacttggacgccatttccgtggcaggatctcactcgggacggcgaaagctaaaccgacggtcgagaagccaacgccaatgagtatggtggccccgattagccggtagatattagtcgaaccaggagcaatcgccgcgccgacaaacgaaacaacagaagccccgacgaggagcagcttgcgcgcttgaaatgtgtccgatatagaagagacgagcggcgagatgacggcctgcatgagggtaagggcgccagggacccaggtctgggcctgggtgttgttgagggaggtgccgatgatggagagctaatgtttacctcttgtcagtatattcaaccgactctgggatcttgtcgccgaagatagaaagggggcgtacttacaacagaaggggggccttgaagtgccagagtctggacgaagttcatcaagaacatcgaggccaacgcaatccatgttcgtaggtgcacaactggttcctcgtcggcgttgtcgtaaacaagattgttctccggaggaccgctgtgcttttcaaagtcttcgacagcctgactttcgtgcttgtaatcttgggttgtcgcatcgacgtgctcttgattcttgagttcggccatgtttgctcacgattgtaggaaatagtggattttaccaagaatgatcctggctcgtttgaggaaatctggagcgactggatcgggcaacgatcccttgaagttatatgcggtctatggttagtctttgcatgaccccggatttcattcgggggccgtctggggaaattggcccacgataaggacgcaggcaaaggcatcctctatcaggcgtcggaactttgcgagtgtcggagacttgcgagtgtcggactttggcgatctaagactaaaaggccatgtaggcggtgggtacgaagaacgagtctcttgttctcgaccaacactagcaaagccatccttgtaccattcggccccttcttgattgtcggtcattggtgccgcttgagggtgacgaagtaagtctcgccaaacaagtgattagtagccttctggacgataacccactccatcttattacttcgacgtacgacgctgtaacattggaccaactacgagacaatagacgctccgacacatacgcatctgccaaaatggagagcacctcttcagaagcaccctggcaagccattgcccgtcggaagcaagccagtcgagacgcacgcatcccatcacaatggcgaatccccctcgctcacctgcctcaggaccctccgcgcttcgaagatggccctcaatctgtgctacatgtcccagctgcggtactgtctgcagaggaaagccagatcacagagaattacagcatcgccacgctggtcgccgccatagcgcgcaggaagctcctcgcagagaccgtgataagcgccttttgccaccgtgcagcagtggcgcatcagttgacgaactgtttgactgagcctttatttgcgcaagccgtagagcgggggcgatttctggaccagtatatggaggagcacgggatgcctctgggccctttgcacggcttgccggtcagtgtcaaggatactttcgacatcaagggcgttgatagctccacgggtttggcgtccttgtgcttcaagccggcggagaagaacgcacctctggtggatctcctactgtcgttgggggcagtcgtggtggccaagaccaacgtgccgcagacgctttcaagtctcgacagcgtcaataatgtctttgggaggaccatgaatcccctcaaccggctgtgcactgctggtgggagctcgggaggcgagggtgtcatggtggccatgagaggctctctcctcggcatcggaacggatcttggtggcagcatcaggatcccagccatggtgaatggtgtctatggtttcaaaccgagtaacttgaggttgccgtatggtgggcaagcagttctggtgcccgagggtatgaccaggataggcgtgcagcctgtggcaggtccactggcgcagagcatggaggacatcaactttgtcatgaaagagttggtgccacgggcaagcctttggggagaagactgcgtattgggagaatgggcggacgcggacctttccaaacccctccagggctccgggccagacggacaagttgtcattggggtgctgcgaaatgacggcaactgcacccttctgccacccgtggatcggattctttctgaggttgtgtcgagcctgagcgagtacgccaatatcacggttgttgaagtcccaaccccaacagcgtggacgcaagcgcaaagtgccatgaacgagctgatcgccattgatgggggggtccatatgggacaactcttgggttcaacgggagagccattggtcccttgggtgaagccaagattcaaagtcggcgagccgtgctcgctcacaagattggccgagctacaagcctggcgttcccagctcgagctcgaaatgttacagatatggtccgagacggatcaatatgggagaaagaggaggaaactcgatgccgttatctgcgccgtggcaccccatcccgtgcctgagatcgaacggttcaactccctcggttacaccagctcttttgtcctatttgactatcccgccggcaccattcctgtcagaaatatggtcgaggaggatcttaatttgggcaaggcactggacggccagtcgctaggtgtctgggacgatcattgccgtgagctgtgggacgagagaactgtaaacaggaaggtgtacttaggaactcccctgagtattcaagtcgttgtgccgcgacttgaggatgaaaagttggggaagcttatggctttgatcgacggcgtcgtaaaaagccacaaaatcagttccaagctgttagagtagaagagtaatataaatcacagtacaacgatcacgaggcaacattgatgaatgcaggatagctttttaatgactggacattacactcaaatctcggtgacagatatttgtatgaatcagttcggctaagtgtcgtatgttgcgggattgagatcccggaggtcttgatctcgccattattttgggcgataaaagtccaatcattcagtgactatgaaactgtaaataactcgtggaaacattgttcaacccatctgtgaggaatgaagaaaccgggtacctcttaggcttgaaagaccatgtagtgacctcgaaatcgaagtcgccgcctcatcatggggagttcggttacctgcaatggctcatgtttgatttcggctgccgttgattatcggttggtgtcttccacttggctgagaggctgacatggataatcagctcgcaaatttccgccgcaacgaccggggcggctcattcctatcttactagcacggacttaggacgagttccggaccggcctgcggataattaagacattaatcagaccaggatgctagcctacctagcttacagctgaattgttgatagactgaaaatttatctttttggcaataatagagctaatgactcacttgggtaattaagaatcctctgcgtacgaggttgtggaggcttaagacgagtcatatgtgttttagcatttaatttgtgtggcttttacatttggaaacagaagacggaggcgccacagacaatacaggttctcatttcaataaaacgtatgattcttatgtatgttcctcgtggcggttgcacagttcctctattatgtctgagaatcccatggacaagttggctgggtcagcctccattaacgccagagttgtgaggcaagatcgcactgttctttgccacgcagcacgttccgccgcactttgtttctcggaagagagcacctgaagcgcagcagcaaataaaagatgagacatggtccaatcggtcgggaagactggcaccttgcactgtgttttgtcgtcagggacagcacaaaaggaacgctggctgtgtctgacaagaacggcgatgcaggacacaacctctcgagccgtgtcaaaaacagacccgattgcttctgggcagaatctcgagataatgagcatactcgcgttgtactgcaaagtaccccatgcgtctaaatattggacggcatcttgccagccatgcacctcgcccgtgatagcgggcacgaagtctgtcttccagtattgataccactcgagtagctctttttgaatattttcgcatctctctttcagcctcgccggataatagtgcacggcggctgcggagagcaggctttgcagttgcatcttgattgtcgagatgcggtaaaactgtatagatatgccctcattcacagtgtcacatgccggcaaggtcaattcctatgaacttgttagtcgagatttatgaccctataaacattctttaccctcacataatgtaatttatctcctattgccaacaccgttggccgaccaaatgcggtggtgacgtttctactttcgtgatcagctcagtgcttcaactccaacgtgagtacgtacccctcgatacagtacaaagttctggcaagcatcgtatgatgaccttcatcaaggtacatgttttcggaacggccatgcgacatatcaaagtggaggcggatggcaaagccaaggttcctccagatatcaccgctgcctgggctcaagagcaagtatatgcatatgaggagagatctctgcatcatgtgtagagtactgggcccagaagaatgatcgcagtttgtgtcagcattggagatggccctgtcgaagtagacagccggtgtgaagctcattgagggttcggctcttttcgtcagtagactggatatagcgagaattaggtagaacaactcccacttttggtccaaacaaggatcagatacttcggtgctgcaacataagagcagaccttggagagactcatcgttcataatggggtaccacacatggactgatcttgaaaataccgcaaacaggcgtgtcacaatcgagatatctggggcctctgcgacctggcccgtagatatcagagaaccgctggtccatccagcactgggctcacttcccaacgtttcggagtaaaagttagttagtgggagcgtaggtgatgtgattgacgcaaggtgactggagactccgaagaagatataatctgcacttgttgtccatttggagtttgtggacgcgcctcgaggcttttctggatcgtctttggataatcccgaggctaggattaagagattgttgccccaagtgggctgtgaggcagccatagagacaggcggggaagctgacgatacctttggaggtgttactcgaggctggcttgctataactagcttctggattaaagaatggatatctctaggaagccaaaggactcatatgagtctcgtttagaacaaatttgattttgagtggagcgagaacgacgtaccgtctgggtatctgttgagatagcagaatatcgtgataaacacactcccggcgcgatctagagcaggcaccacagcatggaagctcgcgatcgcaccgtacatgttggtcacgacaaaaggtgcatgatggcattgaattgataacgtccttgatgtcattaggaagtactgaggttgacgccgtggtagtaagctctgtagtacgtgcaacaggcacttgctgcggctcggctagcaagggaggttcgagaaagttcaacgagtaggcctcctcaaggtcgaattgagctaataggaactcctgccacatatcgtctgagagcggcagttgtgaatcttcctggggcggcgataaaaaatccgcaggaaggagagaagaaggctgaatttcattgtgtgcctgatatatactgcggatgcgacgttgggaaagtaacaattcaagttcctcaaggtatctcagctgataggctgcactagtcggactgactgaatctgaaaacacgaacgtacgcagatctttgacgtacatggcggtggaagcaattactggccatctctgtgatccaagattctgttcaggggaaattagacccttcatccaaggaactttaaaaatatatgtacaaagttacttaccagtatagccatcacggtgtccagcgcagagaggagctcattctctaatgaagcttcgcggatgatagatgcatagttgccgaaaatgtacaacagaacgatggcggcctggaatgtgttgttcaccaccgcaaaagtccaggccaatctctgcgtctggatagtcttgtggtagccgttgatcaggctgattgcacttgtcgtcgcgacgagtagagaagccgggctcggcaccatgcttccagggtgtggtcgatgcagcaggttttgactctggtgtgcatcgttggtgatccattgcggaatggcaccgttaatagaggagacggacaggttcagcgtgcttcttatgcgctcctccatattctcaacccaatggtcgtagctcgaaaactggtctgggatggcccggccgaaaaatttgatctcgtatatttcagactgaagctggcatagctggatttgaagcacaaaatggttcgtactgagccttccgtcggtgtatgatgtgaaggcttcggcggcatggttcccttcgttgccgcatccaggcaaggcaacggtgatatggtcgtcgctcacgttcggcgctgagccggttgagattgcaatcgtcctgtcgatcatatagacctttattcttcacccgtcagtccagccaagggcatctcgataggagttggagaactctaccatccaaaatatccgcctccgaagactgacgtcccgggaagtcagcccctgagtaggatcgggctcttgatgaagacccagtccgacagccatccgtccgacttccccactcaagtagaagacattattgatatatggcaacaggaagcctaactgtatcagtaataaaagtccctgtagagatcttatattggattgcctgaggaaggtccagtggcgcatcgcatcgcggtgaagtgactcgctcattgaagcgactcgggagaagtcatcattccgcgaggccagacagctgactgccagcaccatcgacacaacaaaccggctgaaatccgcggaggaggcatcatctgtctgctgctgtcttgaataaacttgtccaaagtggtaccatagctcgctgctggtgaagcacggataccgtggtaagatggtgttcacgtagttgtcgaagatgtgccgcgcaacttcgaaaggggtagacaaagcatctacgccggagaattgcgactcgtgtccatggcccgcccgtcttccaaggtgttcgtagtagaggctatgtactgggaccttgtgaggaggccgttcggttgggtaaaacagtttggattcatgtaggagtcctgggtgactgcccacgcaagccgtggtgtacaagatgcgtattgacgtgcttacagcgtccaagatttggctgttagcatgcacagagactcctgcgggtctcgaaatcgaaatcgtcgtttctggcaagcggtctgactctggttcgggttctggctctggctggtgtccacggtcacgctcgatctcagccagtcgctttttcaaatactgcagcgcgctgtgaacagattagctctagatagataccctaaaagtgaagagatcagagcagtggaagcaccttcgcgggatctctttgcggctatgtcggttgatgccggcgcattctttccctgccaagctgcaccgagagcagcagggcagcttcttatcgcactggattcaggtcaatatctcacactcataatccagagtcccgagttgacgccaccttcttcttcaaggaataacatctcgcgcaagccaggacaggttggttacgctggcgtctcggcattgttgagctcgtgtgccgacactcaccgaatcaggcgggcggtggttccgggtggatgcctgccttgaatccgaccagcattgagcttgatgagcgtgtcgtagaaattccggggtagttgtaacggggcagggtgtcaagcgaggtgtcacggccttcgatagacaccagattacccgcgggcggagcacagccttcgtcttgcctgcgtgatgacctgaagcacgcgtgaaggacaaaagcttaatcaagccgagctagcaaaagtccgacaactgctttatctacaagttgagtcggagactagcccgagtggatcactcgtagacagatcagggattaggctatgcttcaagggtaaatcgccgagctgggtcagggtatgagtcatggcatggaataaagcggtagacagagcggggagactttgccgcgacggcggatcagtctctgcatatatgagcggacagggtgagtagtggacacgatccaggtgagggaaagtcataaatcacgtcagtgggtggccaacggggttacagggcagatttttctcattacctaagatatttttaacatagaagagcccgtacttcaatgctgtgatgtgctgtgctaaagttgaagaagctcacatgcagttgaatctcaccgcagctggttcctaggttcacaaagtcccatacattccaaagaccataccactcatcacttaagagtaacaagctatatcgagtagtcatgacatccaaggtcgtcattgtcacaggcgcgagcaagggcattggggcggccatcgtagcgtggcttctgggccagtctcataaggtcgttgttacggctcgctccgaggcaccgctacaggcgctcaagaagtctcacccaggtcaagtcgagtatcttgcaggcgatattacggatctcagtgtgagtctcatggcaacactaccgaattgtaaccacgctagctgacaatgagcagatgccagggaagcttgttgagcttgcagtaaaatcgtttggcaagctcaatggactggttatcaaccacagcctccttcagataaacaagctaggaagtgtctccttggaggaggtcaaaagggtgtacgatgtaaatgtttttagcggtatttctctggtacaaacaacggttattccctcatcaggagcaaggctaaccaacacctagataaatgctgcactggatgagttgaggaataccaagggctcgcttgtttgggtatcatctggtgctgccaacatgtcacttgctgcatggggtacctatgcttcatcaaaggccgccgtcaacgccatcctggctcactatgcggtggaggagccggatgtctctagtattgccatcaatcctggtatagtcgacacagatatgcaagctaccatccgcgaccagggcaaggccagtatgtaccaggcagaacatgaaaactttgttgccgtgttcgaagctggtgggctcctaaaacccgagcagccaggttctgtcatagcaaagctggctgttaagccgaccaaggagctcagtggaagatttctgaggtatgtcgaattgaaatttagaattttgacatttttactaataaagttatagctgggactctccagaactggctgccttccagtaggcaaagctggtggagagaatttatgaactcagccatgcagtcagcttcgtggagaccaaggcaagagaaggaaccatttgtgaccagtcgaaagatacagcgttcttttataattatccctttgataataagtactagaatggaacataagaattatcattgcacctcagtgtaaagcaaaacagaacttttctactcctactgtcgcacccgacgaattatccgctgaagcctaggctttgatttaatgggcagaattgtttgaagaaatacgttacacccctagaagaaagtgaatatctatccaggattattacaaattgcatgtacttattctcctacgaagacattccattcgacatttagcaacaaggaattcattaagagtacttctgagaagttgctccggtacaatttgtgaggcttcataaaggacaaatgatacagtccatactatctattgaagggacagtgctatatataatcctatcttctaagagatttctctcctgctagattgactcggatgtagcaaaagactttttctatgagcccaaaaagagtttcagtattccgattctcatcagaccaaaggcttcaactatactgtctcatttaatttcggaaggtcttccaatcgtaagatttctcccaggcggctgcaaatttcaggcaagctaggtccgcatatttgctaccgaccagctgcatgccaacgggaagctcgatagctgcatcttctctagcaggcacaaagccaacaggaatcgaaagagcaggatggccagagtctaccaaccatctgtaagcaaacacatattggcatggagaatcgagggactcactgtcgaatggcgacgtattggcgatcaaacccgtcgtcctcattgcaaatttaagcaagccctctttgtaaccatcttcagggagctttggggccggatatggtagtgtaggcatgactagaacatcgtattctttgagcgccttatcataggcgtcctacaataatgtgaatgccaacacaagtcagcgaccgggcattgaggggtaaggagagagtgacatacactgatatacttttggaggttcatacatttcccttgatgcggcaatccatgcttttctgagagccagaggtggttgagatacaagttggctgcaccggggcttagagagtcgaactgctgttgggtaagacgaggaccaaccaaggccagccgatccgtcatgtaaagttgctttcttccttccataccacctaacagggcttggcgtccaccagggatcccgctggaggccatccagacaagggacgccagcttatgttcggggatcgagacgagactcacgctggcgccgagggcttcgaatttgcccacggcagcccggacgcagtcaattacattctcgtcctggccatctatctcgaaaccttcttggagtacaccgatcttgagcccggccagcattttgctctgaggcttcgacacgatctcgtcgacagcagcaacaaacttgtatttttcactattgcgctccggtaaagcctggcggtcatcccatccgtccggaccggcgattgcctccagaagcaaggcacagtcccttactgtgcgtgtcatgggccctacgtggtcaatcgctgcatctagattgatgatgccggtgtacggcaccaacccccatgtcggtttcaacccgacgattccacacgaggccgcgggaatcctgatgctgccggcctggtcgcagccgatggacatgtccacagcaccatttccgacgaggcgaccggagccgctgctggagcctccagcgctgtatccttttgcccaaggattgtgaacgtggccagtaatagaggtcgccgacagcccttcgaagcaggcgttttcacacgctgccgggatcggatactgtatcagcaagagggttctagccaagaatgaacgtatattagtattataggaagtctacttacctgccttaccgacgatgatgccaccagcgtccatgacgcgggtcgcgacggtagcatcaactttcggtgtccactccaccattgacgtcccatttgtgcatggcactcccgcgagggcgatattatccttcaatgcgatcgttcgtcccttaagcaagtcgcttgtaggtgctatggcctgggccgtaacctagtagtgcatgagctagttagccatgatgaataagagagaaaaccaggagtctcggacttttgctgcccagccgcctagatcattgtcttgtggcatatgaatgtcctttcgagggtacctgctgtgatctggtataggaataacacagctctcatccggcaagctggcaatcacagcttcaaggccgctgacaagcgtgacaaaatctgtggccgtctgctccgacagcttcaaacctgcggtagcggcgatatccacgacatcgttcaaggataccctggctgctttagcatcaactctgactatagacatgatgaagtctcctgatgcgaggttcacaatgtctgtgatatagtttggactgagtaaaaagggacggaaactcggatcttgtcgaacagcctctagaatttagagtcagcagacctgactttaaactaccgtaccatcccaaaatcagaagctacttccatttatgcctctccaaattgccatctcagagcccagtgctccatctcctgtaccatgatgtatactgccggatactggtttgtggttcggctaaagagaacaataatcctgtccccactcgggccagtctccgacttgagtcgtcgtttgagccattgtcggacttttgctaaattagcttgacaaactaaaagttagatccggtggacgactttgaaccctgtagcctagcctgccgtaatgcccgtggacaggagcttgggttgccttggactttgtgtggaaatcttcttctttgattttaccctggagctggaaattttgtcgtaatgacaacatcaagcccacacgctgagtaagataatgaaattggaggcaaaatcggaggagtcattctacggaaaaggcaaattctcaataagattcgtttttaccttggtctctattggtattcttggaattgatccatgatacgcttaattgcgtacgaggatgacaattttttcatcttgaatggttgtgattttcgtcattacgaactgtacgcgctcattcaagttaaagtattcaacaagtctaacatgcaaactatgaatgtaacttgtcatggaacatttattgacgaaggggtactaaccgttcagtattatgagaacatcaggtctgccagaaacgtcaggctgggtgctagtaatggattcctgctaaggtggaaacgaattgagctggatggggtatattgatggtacttatacaaccatctccgacaaattagaattgtttcttgtccaaaggaagtattgccagcttcaattgtgcaatgaattgacattgcgggatggctcttctctttgcggaaacacgcgaacgcttcacgccacgctgaacagcgggactatctgagttccctatccctagaagcccgatcactgtctgtttttctggacaagtctctgtccttttttcgccgatagggaaatatacatgcatatcatatcaatagcgagatagacgccctttgccctgcatgggctttaaccggcaataaacactcacaaacttataaacaaagcagaagtgggtggcatagacgtggcagtgctaaccaaagccccaggatgtaagatcttttgctaaccgaaggcatgggggcgcgtttgatgggtcagagtaatgttgtatcgcaccgtttatccttgtcagcggcacaagtaagctagacaacggcaaatccttcatctaggccactcagctccgcatgaataggtacatcatccatcgaggcgaatgcggcgcagcaaggcgtccgacacttcaagccttaagccctatactaaatactaaggtctttggttgggacccgtaattgaaagagtatattaactcatcctcgacacatgtggtaggctgaacttttctctttaagccaaaccgactttatcaacaacatgacgatgacgagacttcaacgttggcaatctgttgtgctgcaagccactgcactcgcagcgttagggtttgtcattaaccacgaaatcggtcgccgtcataggcaagatgaaagcctctggaatgacccagtgctgatgaattatacgtccacgtttaaatgggcaatgaactcgaccaattcaacgtcccgcctttctctgccctccaacgatactcttaccaacgggatcaccagtgatctagctggatctaactccacaaaaagccaagaacaatcaagcttctatatggtccttttgccacaaaaaatcatcgcgcaggcgataattatgtttctttcataccactggcaccttgctctcgaacgtttattacctgctcgatcagctagggttgagatgcaaagcgagaaagaagtcatcaacgaagaagacggccgagaagaggaaatagtgagaagatggattctcaaaggtcgcgttcagcgatcatccattagctggctaaatacgttcctaaaatgggtaatcgacatgactctaggaattacttggggaaacatcgtatatgaaggattatacgtattttgctttaaaagattgccgaacaaagggatttcccacttcctatgggtgagttcccatatgcaatgaaattgcgtctttgaagcaaggctaacagaacctcaaaacattctagaacatcctcttgaattcattagtgatgatcttcagtccccgctccttgatttcactgatcgggtttatcgtaattccagcaccgcgacgtccagtattcttggctggtatgtcggcgctagcaagcatatttatcagtgtatctacgatgattgtgcttagagggattgtgaaaagcaacattgcccagaagactatgattgatcttacagagcaagtctggagacaagcgcaaaggaaagacgcaacagcggctcgcttggtggatgagctgtgaaaagcaggggccacactgttcttatgccttatcgagtatgcggcctttttggagctggtgtgagatttggtcgaagattgaatttgacgttatgattagaattgtgactttccaaatttatgatgaagttcacggaagttgagcttgtcaattcattgtcggaatctttatgtagatgacatgtcggtctcccgttgattaaatgatcttccgttgtttgtagcgtttcattctgctcagatggatcctgctcaatgaacagccacgtgaatcccaatcgtcggctctctagacttcaacaggccatattcttttctcataacgcccatacggtagaacggcgaccgagacactgtatatgaaaatcctatcttcatacagcctccatcggcatactttgaccacagaaacagtgtaactatctactcagacaaccaaaccaaaaacgagtaagattatttcagagcaggatcaagtatttagcggatactgccgccatcgcctttgttgtttgccagttacctttacgttaggctgaaccatgcctgcacatctgtatcatatgggtaatatgacagcgattccaacgcttcttagaccgtctcatccactctgccacatgcggcaagataaatgttgagagtgctaagttgttgcaccattccaacttttctccattagtagaactctttctaagcttgttttagacattagttgcgaataacgtacatgggacagtagacaaatggacaaggggtcactgggctaggtcataagttcctcctcaccttatttcattcaatacacctggtgagtttcgattggtggatttccgctgcgaatgcttgatgctgacatcttgattaagtgcaaattaaagtgacagctagccctaccgatggcgctggtcgcaaattcctcgcttccatgaaacacatggtatgatgctcccatggaagtcggttgtaagcttgttccttcattaataagaaacctcatagtgaagcgggcgatgcggtctggaaacatattaagcacatctatgtaattcatcctcctgccaagaagactaccgcccatactttggagttgattacttctggcccaaaaatttaccaccctcacagtcagagaaaatcgctggagagcgctaccttcagatgaaggacgtgcaataaattttgactcatttgttgctatgagctgaaagcccatttatttcctccaaaaagaacggttcatgctcaaggtcacatacagagggttctttatgggagactgcacgaggtaatctacacacagcaattgtccatggatgatgcatcaggggagtcgtcactgcatgccaaggccttctcataagcgctgtaggattctcagcctgagtgcaaaaccaatgaacaccacttcccttgaatgtaagcaaatgcagttccgacccccttgccaatttaatttgtgccagactccttattggcctggtcggactcaggggcggggcaacggctgagcgaatcctaccaaataagaagaacctgaggacaagaataagaggagggaaccaagaggcgcgtaccaccagacctcgagactcccgagcgctccaaggtcttgggcggagaaaacgccacgatggcacgacacgggtttgttagctggggcttcattgtctcatgtttgctacttgttgcatgtgcagcctcttccgaagatgatgtaaaatttatgggctacttcatcaatggcctcaccagtaagacttgcctattttggtatgggattagttctcgtgtactgacttcaaatcgggtagctgagaagttgatggccccctcttcttttgatgtttggtcaacgacaggaaccgtcgcgggtggatgcgaaacggctaaaccgacgtgcgagatcaatatcggatgtcaagatggaaccctgacaaggactgataatgtgaaaactctctggtgagtcccctcttaggttccgaaggttgattctgggctatcttgtgttcgagagctcgaccaattattaacaccatcacagcacaggatcgcaggtctgccagaccatgacaatctatcagaattttccttccagcggaccgacagtcaaacatttcttttgcgcaaacgtatggccggcgaaaacggtatatcgtgacctgcgccaggtagcgacgactacaacttcatccgaattggctccatcatcatccattttggctccgtcgtcttccgaattgggtccaacgagtgttcaaataaatacactagatacagacacgtcgacccgggcgatcatgacacagacgacgtccacacaaacgagcgccacaagctcagtgcccacggaaagcgcggatgcatccggttcttcatcgaagtcaacagtcgaccagaaggcatggattgccggtcctgtcctcggtggcctcatcgttctcgccctttttgcgggtggtatgttctggtggggcagaaggtcccgaggaagaggtgaacgcgaaggagacaataccaggaacttccagtcaattcctgaggagacgaagttcgggtatcaacccccgtcgtcgtatggcgaagcgcctatcccgatggcgtatcaacctcagtctcatgtcagtgaaatgtggtcctcgaggtcaccaacggagctgggaacgaactcggcgatatatcagccaaaaccccaacctcctacccaagtccaagagctgccagctccttattatcggtaatgaaaccatactttgtgtggataattatagagaaatttattgataccacaagatcatcagcaattacctccctgttatttttggtgatctgtagcgaggttgtagatgaagtttattccaaatactggaatggggatacgtacaagctcaaacaacggatagtgttggcgtttaacagggaactgcgggtatttatgggttggcttatgaattaatgacaaccgaaggccttattagtgttataattgtatataatgtaattgagtacacggagactaaattatcgagagaaagagaacctgaaagtaaagacctttcaatgtcacccagtcgctcagttactctaccagctctactcaagagagccaagccagctcctacttttccgtcgttagcggcgcaagcctagatcggcccaagaagttgatatcttgctatacgagaagtcttgtgtatcatgaattgacgaaaacgtcacagttttacattttgcagggactaaagaggccatcactaattttaagcatgcctaggcttttcttcgaccgcttcttgccacgccctcaaactggctatctctttgacaatatctaccccctaaatacattccttttcctttaatttccaacgcgtgactttatggtatagccaaggtgacatctcttgttttatggtatttgattttaatctaataccgaacccctccatttagttgctacatactttcttgtagtcttgacatgagccttggaactactgatgtatgacaacacgggggtagcgatgggatcaaatccacaatttacaattggctgaacatgtacttgatacccgcccaatgctcggccccagaaggcaaaatgttttcgggtgggatgacaaaaccgccttcagctgctgtaggacgcagctccaccaaccaggagaactcagcgcccgccacatcgaaagcccagtctgtactgctcccggcagtttgatagagatctgtacaagtcgggccaacactgaactcaagcccgttcacacccgcgatcgcagaggcgacaccattacccacagacagctgtctctcgtagttatctggataggccgtgcagttgtatccatacggcaagaggatctttttcccataggaatgccagtctatgtaggctttgattcctggtccgttggctagatctaggatatgggctaccaaggcttgaatttcaggtgtatctccgggcgcctcgccacgaaaggtgttggagcagggatctggtgacgaaccccctggaacattccaatggctgggccagttgcggttcacgtcggtaccgatgcaggtttgattgttcctgatttggcggttcttgcgccaaagcctctcagactcgtgagtgtagacaaaccctggaacgcattagtaggacaagcaacaatgcaagtagaggagcaaataccatctggattgacaattggcaagatataaaagtcatacttgtctaacacattgatgatcgcagagtctccggcttgatacgcctctatcagcttatacgtaatatattctacggtctattcaaaatgttagcactcgccgattagacttgttggaaggtccccgtactggtgcagaaatccactctctggcatgcgcagttccgtgccagacaattgccggcttgaggccattcccagcctctccccataggtgtattcctggaagttcacggccctcaacggatgggccgagcgagaaggtatctgagttgtttgggaacgcggcttggaggtcgatgagaaattgaatgtgctcatcatatggatggtaggagtcaaagtacgataagggtgggagatcagcgagtactccctcaatctttgccgtagctatggattttggcgttagctatataccaagcaggagaaatatagcgtagaagaactgaccgctatatgttaagaatggaccctccgtctttaataccgcaccaagatcatcaatcagagtagtgaggtcgatcccaagctggcgggcggcttgtagttgatcaggtgggacggcgacatcaaaggcctcattatggggatctttagatagcagaattgacttgaggttggatagagactgttcaaactcttccatgtcaccgggattttcaattctgaatattttgaacccatcatacgagatcttggcagtagcaagagagcaaaaaatgcctagagctgctagagtcttcattgcaacagtgaggttgatagaacgaaatacagcgcatgaactggaagggcaatatcgggtcgaatgttttagatcgttagtttggggaactgtaaaattaaaaaagaagaagcaccccggcgttaaattactttaactcataggagctccctattgagcagtatttcttgggagcggggccatatgagctcttatcgttgatgaattacgaatctaaccttgaatgccatgcatctgttgaaataaccttcttgactggttaagtttctctgttgtcagggataaatcgtagcactgaaagaggggcaacctgcgcgttgcttgaatactacctagccaaatggcacctaccgtcttgaggtctttttatacggcagtctttagagttacgggaagccagggtaatgtcaccgatgggttaagattctcagagggcccaatgacggatctccgcgcggataaagtcccttgaacactgataaaataggtaaccctgtaaactcctttttcgttttttaaacccacttcttccccgaatttaacctcgtacgatggacgttgccgtctgaattgctagcggttcgatgctgacctcgctcagactgtataacacattccccggaagtgcgaatcctgacctccgccgactttagtttccctggcctgatggcaacacattcaaggcaaaaagatgatgacataacaattgggtaattctcagtgggtaggtttggtatcaacatatatgagggttgttgtccttgaattacgagggtaggtggcgcggtcgccggatatcgacgttagatcctcccatcgcacagtgatgaggtatttcatatctgtccttcaacggagtataaactgacttcattgctatgggataagggaggcagcgttgacttttctaatgactcccagaattatgagtcaaaagacgactttagaaaggtcattgctcaatgcgcaacgcaaatagagtaactgctgcttatttattatccaaggcgctggaactacgatgcaatttaggaaaaaacctgcctcaatcctgctaccttttcaataatgtttattcaagagttcagcaattttattcaagcaagtgaattgagacccagaacggacctctttgatgagatgcagggaacgctaggcggccgcgcgttaggagtaatatccacgacaagacttggaacacgacctagagaagcgttctggaacattatatgcagcgtatagttgttttgatgggcccgacgtcttggtcagcatggatccgttgactatagtccgtcctggacagtccaacctgattccaatatcgatgagggggatcggccgggagatcaggccaaaggaggtcacaagacgggcgatatgtcattgtccgttttcgggaatctcggaggagcgttccatcgagcctattcccagaagtcaatcacacgaagtcaatcacacgaagtcaatcacacgcagcctttgcacgctgaacgtaccctctgaaagagaggatgaccgtttagtcctcaatccttgctgaacaacttccaggattttaatcttggccaggttctcatggtcagaatgcggagattctgtttattcgagtgcgatcgtgcgatcgccaagaactccggcacactgtgtatgaacataagcttggcacattccttcgaccataatttaagtatctcgatacagttagtcttgcaaattggaactgtatgcggggtagaacgagtctatgatgcatcactccggactagtagctccggccatctgtgtgtaacgtctttgtgaaacctggctggctcgatcacatcgatttctgcctccaatccgatcagggcagacatggataactgaatacgcacacacatgacgatcccccttgatattataaagatccaaagcgccgccggtgtaatccttccgtcatcccccttttcagctcttcctgtctgacctctaatcacagtaaataaaacatcctccgtgtcctttattccgttttcattcctatctctgatgaaatctgtctatccttgacgtcatcgatcttgtcttgtgaaattggtcagattggcgatattaggtgtgggatttacacggctcaggatttcgacatgctattcgaccacagtatgtattggaaacaccgatggcctttgtagccttgtctctaacaaattcgtcatcagatggccgaccagagcgacagccacaaagaacgcgcatacatcgccgcctcgagacgacacgaccgtggcattgaagcccgcctcgaatcggcgcgacaagcgagcaaaatacacaaaaaacggacgggcagagcactccgcatatccgaggaaattgttcttggagacgccgcatacgaagaagaggaggcgccccggaggcgccagctctcgggctcaccgctgatgcaaaacatgcagtggcaggcagatccctttgccgctgctttatcttccggcagccctcagacacacatgtttacggagaaggagtggcgcgagaacatggtcaaccaggccttttctcaagccttccctcagcttgatgcgaggctctctcagcggtggccagcccaatattttgtacccagggagcatgggcagccagggcaatttagatccccatctattgcctcatctaacataagttcgcagtcggcactatctggccaattcgtggatgcaccaaattctgagacgtcatcaccacttctgcccacgggcacacaattcccaggccactttaaccaagagggggtggatgggccgaattaacaatgaataataactttgaattggcctcaccgccacaatgtactggatgacaagagattgtcgacagttcagatgataactatgtgccgtgagtggtctgagcaggcgtgcacgttgggtttggatgcgatgtctttgtcgaatattcttctgtcagacttatcaggcgcattataatgcaacaagatccttgccggagcatagagctggagactttggtacagtggtacggaaagataagatgagataagtcgcatgacaagcgtatctctatagcattataagaccggaccatcactggtaccgattcgatacttgtacaagaaacaacataacaactaatctttgtttcgaaccatatcttatggaccgtagcctttgatttgatattctttttaaactgcccacaaggatggcccagctacggcgacatctgattgtttggtagaacaactagcatcacgatagcacatgattctaaatttgacacctaccactctcatgattcctttcacttcccagaaggatttccgttgaacgcaagcttattcggcgtgtcctcgggaatcccaccaagtttgccttcagtagccatatccgcgatccttttgcaaagagtttgagggtctgtgaatccttctagaccagcaagatacgcagcgagacctgcaatgtgaggggacgccattgaagtgccggatttctcgccctcagtaccgcctgggagtgcagagagaatattctggcccggtgcatacacatcaacagccgcgccatagtttgaatggagccatcgtccatcccagggcgatgcagcaccaacagtgcagacggtaggctctgacgcaggagagaagtcctcggcgtccgtgttgctgtttcctgcagcgacggcgaggaatatgttcttcttcaccatgcttgccgcggcctcattgattgaggtcgagaaagcgccgcccacggacatgttggagactacaccttgggtgcagttgcgcttggcagagtcctcggcgacgaaatccatgcccttgatgaaacctgccaaggagccatcgccgtctttagtgaggactcttatgccgagaagcctggtcttctttgccacgccgtacttggcaccgccgatggtggcagcaacatgagtcccatggccgtcatcgtctgtgttgatgttgtccacgaaattggcgaccatctccgcccgtccttcgaagtcctgccgcaaagtaaatattagcgcgtcatgatctagaaccgggttgagacaaactcacgggatgggtagcatcaattcctgtgtcaataacataagcacatgtcccagctcctgcgctggaatcataggtatatgggattccagtcttgcggtcgcgagtagatatacgacccaatccccacggcggcgaagcctgctcgacatatgcatacgccgaaagtgaagagtcctgctcaacatactcgaccttgcgctgtacgtcagcaattgcgtccgagacattcttggatagtgtatcctcacatcgttgctatggcgaagagcttcgagctcctcgtcagtaagctggccggagaatccttggaaggtggtcttgtagacatggtctggggacacgtttaaggtgctgattttattattgagcgccgatacggacatcttgtccccgcctttaccatccttgaatttgacaatatattttcccgccagcaggtttctatcgtcggtgcgaggccgaaggagtggcgctcgttcccgcctggctggcactgccatcgccaatgggagaactataagaaagagtgatagacgcatggtgaactgaagaatgaagtgagtggatggatgcgtggatggagagacccgcgaacacaagtaaaggtcactgaagtagaaggctgtccaatttatgctgcctcactccaattgagctttcttgacagtctaatcgcaagttcattattcatatacccctttgtcggtttcatcacgagacattctcgtccatctttacaggctttaatccataggaggcagccacaatgaaaagccaaggacacgtcacatagatatgggccattcttgaccaataccaccgaccttttctcatctgtactcttttagaaacagttgtatgcgccctaggtcccaagctcaaacctagccaagcaacgtagcgtagcaacgttgtaggaatctagggaatggttttgcttctcgttctcgtaagcacttagcgcacaactcatgcaggttgacgagtggctgtcgatcccccagccgatggatggtctcaactgtagtgtcagcaccagcgctactttcgcccaatgtgatccaataacctcctaaagatgtcccatagagacgctggcttgtttaatcatgcgccgtggcgtaaatgactggaagaggcagcttgtttcgcctacattactttcaacttaactgaaacatggctcagctcaggcgcgaagctgcataaaatcagaaaagaggtcaattcgcgcactaatgagcagaaacaataatgacaaggaatcataggagtaggcgggtttgttcactatcatctcatagctaaggaggtatgccgggaaccagactgacattctggaatttgggcgaaaatcatcccagtaattcctctctatataatcctacagttgattcaattctcaaaccttgaccgctcccaccaggctcccgtatttcaaagagttcaatgtcgcagcatactgccccctctctggtgacacggtcacaatcatcgacgagcttcctttctcagccgaccggagaaaatgttcacgtagcaccatggtcaacggcgatgacctaaaagggatccgcgtctggctggtcgaccaggccctcatgacctccttcaatgccaataaatccgtgttgatctggcgaccctcttggcgctctttgggtgtctgtttcagcatcggcattttggaactcttctcggtatggtactcggcgcctgcgagatctacaaagacaattttggcgcccaaacatggagacgagaacgagtcgagcgtagaatcgacgcacttctctgcatctgcaatacgcgcttcacactcggccttttcggccagagctccatcgacgcgctcttggtctacttggtaatccgggttgggcttccaacttccatcgggtgccttgacgacggtcttcatttgctcttcgatcaagatatcatccgcctgctttcctactggaacaagctctgactgtcgctggacaacgacctctctcgcatccaccagctcctggttgataatctccagctccaagacggcgtgagtgcgagagcttaggtcatggacactggacgaaccaaccacgcgctttcccattgcctggatcagctctcggcgtatgttgtcaaaatcccagcaggggcgcttcaggatgggccgaactcggaccttgcccccttcgagcttctccgtctcgccgcgaatgtgtgtcttgccgtcgtagccctctcgaatatggcactcggcgcgcccatttaggagatcgaaagctgtattcttcctgagttcgaacaagctgaacccgaggcctagccgtttttcagtttggagttgacggtttaggggctctagggcgtcgaacaatcgcttcgcagctgcaagacataggccaagctgcttgctgtcctcatagtcgtacccaacaatcgtgtgtgtttttccacttccagagtgaccataggcaaagaagctgcagctccccccttgcaggacattggggatggccggtgcgacaatggtctcataagctttggcattgtcatcgctaggaccaagaatggcggtgaaggctggggagctcttccacccgccgtctttgaaagttgaggtagagcttgtgactgatactgagagaagggattcaggagtagtagacgatacgcgatgagatatctcgctctctccggcgttggagtgaggcaacggtcgccatcgagcgtacacgttcatggactttggcttggacggcatgttggttccggtatttcgagggtgagctgctctcggaaatcttagggatttgcgccgctctttattggcaatccacgatgaccgaatctcgttgcctgcagcggagtgagtcgatgcctgatgcaagggtaattaaatacatgtagctaggcagccagaaccgacggctgaaggtgccgctgtggagccttagcaatataggtgagacgattggatgaacgattgacgatggactgatgaagatctgctgtgatcgcaggtaaacagacacttaactttcttcgggaggcctaatatctataaaatgcaatcactttgttgtcaggggtggcgcatgctacctatatgtcggaagacagtcccaatcgctcgtctcaactgccgccagccaggtcaaatgcaccgtgattgattaagatatgccaggtcagcaacagaaaagagatacgttcgataaaccggcttgcattgtaaagtaccaacctttgtgaccataaattgtggccacggccaatcacgctccatattgaattgtggatagaatggccatatgtaacaaaaatctggcacacggcagatcacatatgatacatcccgtattggctttccattctagctcagatctttgtcggggtaggccagtactatcagctgctagaaaaagaagggaactacccggacaccaagatctcaaccttgatgctatacccagtatcacaacagatcaaacccatctgaatggagctgaggctacagtgtgcgcataatgtttgggcatcaccggccttcatcataacatatgaccgttaacttctcaaatttattcttatcaaagtaagcaaaacgtaccacaagtgatcacctcaatatcttcgaaagtgcgcattcttgcggaaagtcggctctttgggttgaccagtctaaatagctattcccaccatagctatctaagggtgctgctgtccattgatatccgttatggctctgcaaggtccttccattgtaaaaacgcacagcaagaattagaataatcggattctgatcttgattggaggatgcagggccttggtttctatgttttggtctccgctgtttatagagcccatagacggcacacggctcccaacgccgattgaagcagcaagcttgacctcaatgccttattcaactaggattagccatctctttttcgccgctgagacccataagtagcagaaatgataaaaggtttggatcagaattgacttagctagcctagaagggaaatcaaaagtgcttgatgtttttaggagagccgtccaacaaggagaggctttattaattcccaaatatgctttagttaacttaggctgcagtcttgaatcgcagagaactacatggctcatccgtcatgcagtactctggcagctgttggctgtgaaatatcttcttatccggcatccaaggtcgtttcttgcgcttctagtgaaactgcggagataaacgtgtgggaactaagtaacggcctcttacgatatgagggtggctttctattaaaaccatctgctacttcaacgttcccccattatgtctttggcttgaatttaaaacatggtgacacctctggagaggaagtgactagtccacagaacaccagggttagctcctgttgaaatgatgccaccactaggacgtatcgaccctgcatcgctgtcttaactatttctttgacttgccagtagtcagctaatagaaagagaaagcatcttaatcacactttcaagcactcaacctggctagtgacccatgatagctcccaccgttcataagggagctgctccaccatcaccgggctcctaacttacttcttacaacgacctcattatttgtaaaaaaaagttgcggtgagtacgcagatgagcccttctttagaaacagcttgctaatgcatcatcacatctgtagtcgcagaaactttggggacttggatatcactcttagaaaaggtctctactactctcacctccagcatgagcttgcgaatcgcacatgatttccggtccaggtcccgatattcgcgtacacggaatttccatggacaatcatagtcatatcaagttcgactccctacgctcaattagctttcatagggcatagactggaaagacaccaatccacccgaatagcggcgaccgagcacaagatcgggtgacatgccaataagatcaagattcgcagcatagccaagacccagcagcaacttggcttgtgaggttaggggttggcagcgccacacaggtgttcgatgtgaggccctgcaagatcttggtggctccattcttaattgcactaccaattgtgcctcagttacggtatgcttcgaggcgtgcgcgtggtaaattgcagacgcgagctgatcatcgagacaacacacgtgtgttattattacctgcacttctgctcagccctgacaggctcggctttggcgggggacccgcttgacatgcagtacctattgacctgtctgattgtagggctatatcgaaatctcactccgcccaaactcccacatcctcaaactcccaaatctccaaactcccaaatctcactccattcggctctctccttcacactagcagggatcttcagcggtacgcatcagagcaggcccacgcatcagacgcacacgagcacagctgtgcgattccactgcagttgcaccagactcagccaggcctgccaagcaaagcccgccggcgggtgtggggacaggcatattcacagacgttggactatttgaattcactgcgtcggatgttaagccccctgtaccatgcatctagcaatgccattaaaaatgacacaccggccaatgatccatcttcggcagtgtagggcaatcaattggcagtataaaggaacaagagacgtctcagtccaaatcatctacgttcaacttgccattaactttctacactacctttctacacctcgctctattcttcattggcttacacattataccctagttcttcccttatccttgtttttcttccaactgctgttttcacggtcctcaaatagatgagcttggatgatccacgatgttaaagcgaagtgtgccgatgccctccccacccacgcatgtgggacccgtgtgcaagcgaaaccgtccttcgcctcgaactggaggaatatcattagattttgcatcagacaccgtggaggtatccgagggctttgcctgccccttcttcaggaaagaccctgtgcagcatatggcttgcctcagccgcaaattgaagcggattggagacgtcaagcagcatatacaccggcgtcacctcaatgacatcgtgcagtgctctacctgcaatctggcattcggctcatctatcgaccgtgatgagcatgtcaatttgtctcgttgctcctataccgttcagcaaagcatcgcagagaggctgagagcccgtgccccccgtgggatgccacccacaggcatgtattcagatctctgtgacattctattcggcaagcaagaaatacctctggagccttaccttggccccgtgctgctggaaagcaacgcactgctctggaacttctggcaatcagagaaggcctcaattgttcaaactgcaatcaaggatcagtcttcatccaccaccccagcagacgtttctctcatggtattagccatagtcgagcagcttcgcatgaggtttgagcaacatgttaaagcatcacaactcggtgaaccacccagcacccctgcgtctaggacgctttccaacacccaggaagaaattctccgagccaaccctttgtcaatgcagaattttggctataacaaagcctcggacgtctcgtttgaagctcaattgccaactgcagaggaatctcacaattcaatgtctctcctagctagcgcaggcaccgccatgtccatgaatgacgatacaagcaccttcttgaatacaatcgattcaaataatggtagcagcgacctctcattgttgagaggagatgagtatcacacttcagtggaaattatgttcgcacctggggcaaatctttcgacaaatcttgactttgactttatttttatgtagatatgcgtgcgtgtgtagggttgaggagtaagatgaatgtattgaaggctaggcgctaggataacgtaaacggggatttttttttttttaaattgttgggtttacagaacgcttgtttagggaatttcatacaagaattcattcgatgccagaattatctcaaaatcatgcaagggtagaataggcaagtcagtcaaacaatcctaggcagcggccgttttttatgctttcattcaataaatgtcagtgctgtggctttggttgctttcatggtacgaatttgcttggctaaggggctatttagataacatcaaggaatgactatggtttaaggtgtgcactgggtaaatccaatcatcaaaatcacccaaggtaatgtagagccaccacgccccgtcaacaataagcctttttacgaactttgtaaattcctactctcaagggaggagtggtggcaattcatttaatacgatcttgaatcagaacatcattctttgccgttcatgtgactccagatgtctatgtgtaatgccactgcttagctataaataaccctgcctttgtgcggattctctttgtatttaccccaaatgagaagaaccctttgtttccggaaaatatgaaaagcatcactaccaccaccccgtttccaaactttgtaatattttctcttcatcaaattatcacgcgcgcgcaccaaaaccaatacaccactacctaaatccaaacactttatctcggacatgatatccctcattattttaatattcagctgccttgcatcgaccacttttgccatatcgattccatcgacaacctttccgcagcctaaagacaatcaggagccttcccctagcaaaagggttcccggaaccgccggtggtctcgatgattcttcctcccttccattgagaagtccaacgtgggctgtaaagagtgagatagccaaaccccactggctctttacattatttcaaacgaaagaacaagtctaatgcttacgatattaggggaggactatgagcagatctatgtacactgccaagtgagagaaagatttacaccatcatgggtataaaggagtccagtcttgattcccaaaccgaaaaggagcatctgattaactatctatagggaccagatgccaaactatgcattgaggagctcgccagccgcggacaagaggcatgtagagccacaaagcaggagaccgtcctgtgcaggaagggcaacacggttattacgagccaagttattggaaagagtgaagatactgtgacttcttggtatgtcccacccccgacgcctactacttgttcactggctgatatataatagcggaaatgttgctgtttcggccggtcggatcatggataaatgttatcatcaggacaataccgtggttggattcgctattgcgatggggacatacacctttcgggtagatattcgaccggagtaaacaattcgctttatagctcggccataagcctctcaagtcactcatctgtctttgttatcgtcaaagcacacggtatccagagttctctgccacccacctctttgcatttaaatactctcaattaagaacactttaccaagatacaaaactgcacatgattttaggttcagatgttcaataatagcattatctaatgttatcttagggtcgttactgtaataagccttctcaacacgaaccttcgtccaacaaatgcttccacttagcctaataccaagctttttaggatctcttggaaaccaccgaagaaaaaaaaaatctcgtcgtgtgcgatttgcctcccaaatcttatttccagccaccaaaagcatcaaaagtttggcctagggcaaaacatatgaatgccctggccagtgcattttgctgaaacttgttttttcaaaaggcaaaatttttgacacgaaatattaaagtcgactacagccattctgtccattctgttatcccgcgtcgctttgcaatgtggtcagtgttaaaagctgtgaccatgcggtccctcttctcggccatggtctttgcgcatatctcgtcagctgccatagcggaagacatcgagccttgtcaaaagtttgctgagctgctacgagaaggtcggtcaaaaacaaccctggagaacccgtacaactacccggctgaagtgcttgtggacgctgagactgcttaccaatgtgcaacctccatcccgatcagcaatgatgaggttgctcgggttatctacaagttcaagaatattcttcccatgtactctacactgggcttcctaaaaaatccgccagcttcctaccagcagccgtccatcgatgtcatggcatatttggatcatattgatgagaaggcgaaacaaaacaaatacgcaaatttctatgagtatgagtctgatttgtctcttatggcgaatcaagtacatgaccagcattttcgtcttcgaaacggtggcatgtatcagttccggtggtatctccccgatgacatcgtgtcagtctccagagatgggaaagagctgccccaagtctacgtcttaagtgatatcagcagaaaagtcccgtcagcttcaccgattatcgaacttgacgaggagcctattgtctcttatctcgagagatacgcgagaaccaaagcttccacggggctgcttgagccccatgcggaatggaacgccttgatgtacaatccggctatcgagttcagtacctggggtagccgcaacagcagctctgtctatacatccgagttccgaagcacatcgtcatataatggcaattccatcaaaggcaaatttgcgaatgggactaagtttgagtggaaatacatggctggctccaaagccatttttaacttgacaaaactctcgagcgggcggtcaatctacgataactggatcacttctaataataagtcaagaatgggcaagactgaagaagacaaacagatgcggaagcttttctccaagaaaacaacggcattcaatccatcaagctcggtaccatatccaagctacccggataatcctatcgtggttcagagcaacttttcaagaggcggaaccgtgtcggggtatctcttgtctgacaattctactggtgtgctgagcatcccaagcttcatggccggaatgtataaggagggcccagaagagcttcatacggcagtcgctgaattcattaccaagtctcgcgaggctggagtgaagaagatagtcatcgatctctctggaaatcgcggtggttttctgcttctcgcttacgacacgtttcgccaattcttcccgaaaatggacccctattctttggcaaattcgcgagccagcgatgatctaaacaccatcggctctgtattgtcccacgtcgcaatggtctctaatgactcgttgaaaggccctctcaatcgaacaatggcgcaaaacctcgggactggggacttgggcatgtacggcaccctatccagggaatccaaaccttggaagtcatggaaagaactatttgggcctgtcactatcaatcaagacaactacaccaacccgtggagatacgatttcaattcaacgagaataataggccgcctcggatacaacatgaccggctatgaagataatcaaagagattacgaacaagctttcgacccggaaaatatcatcctgctgcacgatggacattgcggtagtgcctgctttatcttttccagtttgatgaagaatattgctggtgtcaagagcgtcgtggttggcggaatgccggtcaacggaccaatgcaaggcgtggcgggcacgagaggttgccaagtgagacagtccgacgccattatcaaaatatctcatatgatcaatatggctctatcaggcattaggagccgaagtgataagatcgtacgctccaagctaggtgccacagctcaggaaatcaacttcctcccgtcgcccataggcactccgtggagagatgtaagtgcaagcatcaataccttgaactgtctccccagctccgaccctcaaatcccgtatcagtttctgtacgaggcctcgaattgtaggctgttctacaccatggacatgattcaagatgtcacatatctctggagagcagccgcggcggttgcaggaggagatacatcaacttgtgtccctggatctgtggatggacccggctctgagcctaacaaacccctcaatgtctcccctgaaattccgtacgctaatccttggggaaattcggttcggaccaatctgccacgggatgacccagttcagaatagcggagggttttgcactatgtcaagagccggaggttctgtcagcgtggcggcagcgatctttgcctttgcatggctactatgagaggcgccgatgttttggtgggcggcacgcttgtctgtttgcgataggtcttgcttcagtttggtagcgtatgcaagtatacctcgcctaatattccactttcctatttcatctctcataacttcctagctattacgtattagaataggcaagaatgtgattaatctgtaagcttgttcaaagttctttcatgcctttcaagcaaaactatcgaggattgatccttccctcaaaatatcagacttgatatatgcctgtctagatgtctatgaaatgtaatgaaatctattacaaaattcaatatgcaaactcagaccactactccgtgacactatccttgatactgcgtaatgcgctcgtcccgtgcgaggggtcgatgttgagagcattcttcgctcggcgacgtgcatcagtccagatcatgaactcttcatatgacttggggatgacttgtagctgcttctccacaagaaaagtatagttgaacatgcccgtcgactttttggtgccgtgctccacgtctcgaaccttggagtcgacacgaacgtggacctttgtgaatttgcttgagtcaccctcccgggcctcaggttcggtatatgctactgaggcacggaggtacagcacgcttccgactggcactgggttctcaaaggtgcttgggtcaagggcgaggaagttgggccggctgtgggagacggaggcagcacagcaaaaggcaagctcgaaggtctgcttaagtaggaaaccaccgaagatcatgaagttgtgtctgttacgatcctgaggctgcatgatcattgcagatttaaggactgtatcgctcatgtatatttggtcttctggttggatgttaggatattgcggatctaaagcacaaagttagcaattgagggcatccgtttaatttcaagcaccgcggccgacatactacgatattttgtctccttcttccacatggcatgaatcaatgcagattcttcatcatcaggagacgtttccaggagactccgctttcgtaatgccttcttggcattgtagttttgttcgccttttgcgaagagggacttctcttcgggagtttcgacgatcaaaggcgccacagggacaggcctaacgcagatatcagcatataagcaaatttcggtgtttccatcccagatggcatggcgggcgacatacagcttggtcgccggatcaagcgacacaaatgtgaaagcacaagtgatcatcacatcctcgggtctggcctcctcgccttccgggcgtgccttggaaacttgaacagaaacctccatactcgatcgaccagtagcatatgtgacttgaccactaagttcaagatcacagatctccatcaacgggtgttgaatgctgattcgatccacggctgcggtgacattgctcacgccatcaccagtgtgtcgtgctgcaattatgccggccaatgcgtcaagatccattaccaaagaaccaagtctagattctctgttagtaactagaccacttgagaatcgcaagggcagcatgtcaggctggttgtggatgctcaccgaatgtgcccagaggaattgaggtatgtgtctagcagccatttgtcctgggccaagggcaagatctgcaaccgtgagaaacagcccaaaaatataaattaggccttatatctgcttacagcgctataatagctatccgacatcttcttcggcgtgaggtcgggcttgacaggttggatggtctgcaacccatattctagcttgcgtgatgtctcctggctctgagtcaaggcctcaatccatggcgtcttgacgcgcatcggcatccaagcattgcgtgttcctgtcctcttcgatgtcatgtggaatcccctggcgctcgcacaggagcaccgcgggatggccgccgaataagacgaccgggcagcgaggtttggccctctgagtgaaaccctcctccctacaatggctgacatgttggatgatgagttcagcaggtaagatagtcaagggatgtaaatggatgaagtattcgtcataggggatataatcagaactcgggagaatcttattgggtcccagatcggacaaaatttgcccgatgcaccaaccgatcgtacatatgcaagacctcgggaagcggacgagaaccgggacagggcacgacaaaattccggtgtgaagataaaagtttctcttatcgtgtgctgacttagcttgtactacggttatttttgtccctttactaagccaaaatatgtgctagtgtggcccgacgcagagagctttgaccgaagataagcggtgctgggggctccttggccacgatttctgtgatggaatctcggacagcatcggtatatcaatcttgagttaagaccagcatttacagctattcctatattgatcagtttgaccacgtaatttgggttggttgtcattcgtcaacacatctggccaactaaatggtttgggtaaactcgctcgtaatcggtaattctaacctcgggtattcatctctccattttgctttggccattatgaatgactatgacgtcatgcttcacacagctcctgaagcaatttgtatgaccgcctttgtctaggatacgaaatacagtattgtgagaaagcaaagcgacgaaagtacatacacgataaatatgtgttgcatgcattcactcaataagagccagaatctctggctttactgtcttatgtttttagacgcaagaccttcaagcagcatgtcctacaacaaatccataacctaggaagtgtaccattatcggacatgcacaacttcgaggaagcccagctagacaacttcacggaacagtcaaagaagagaatcgtaaaaaaattgccagacagataactcttggcttccactaagtgatgcaactgtggtgaagggtcactattcgccaaaacatctgtactgagattcaggtttccagttactgaatcgaagtcaagcaatgcgcttcggaatataaccatgacgccagaacaaaggcaaattaacaaaaggaatcccatgtaacacaaagctgaaatgaaacgttgaccctaggtaacgttaatgaggtccttgtcagtgactgaagcaaatctcatagttgcgaacacgaatgcaccataatggatcatcaactcagaacgagcatactctcgcggactcgtctctttcttttgccaggaacctggatgtccgtacctacctgcgtagaacggtcgttggcgggttgttcttttaggttaagctactgccggaggcgtcgatactaggcgtcgacatggatacaacgtcgatgtcattgtagaagttgtctctcgttcactggctatcgatgctttattgatacctaattatgatttctgggagagcaagattatccttgaaactctctattactaacataactcgaggcattttatattttcacatagaacccaataagtaatcacggggcaaaccactgtttccggcggtaactacggctatatcgaccatggttattactgctgttcgaaaaatggctacacaaatttttgtagattttcgaggcaacgactcgtttgacgccatcctgcaaacaattaccaggggaagccctaaaaaactcaagaagaacttctctgtatctttgttggcagctgtggatgataacgcaaacgtgagaaaggtccatgagaattacatagatatcgaggagcaattcctcatgtatgcctacaaggatttctgtgacttcattacggatttccgctttaatcgcaccgagaaaccgacaaacggatgcagacagagctggcgaatcgggatcccaagttcaaccttgaaaaagcgaccccggaggaaaggatcaaatggcggcgtgcttacaccatcaactggttgtatgaccttgtcaacctgttttcctcgatcgtcgtccaacggatcactatccaaggagaaacgcataatctcaccacagtggactggtcaaccagcggtccatggaatcagcaccgcaggctatttggtctcaatgaatttgccggcttcgttacgtcgctggcgttccaagccccatcggcagacctgaaatccaagatacgtccccatcatgtattccagcttcagtgtatagtagattctatgacggtgtctagcggatggcgggtgaactgtctctatggtcatatcatcactgcccctcccccaaagttctttccgcgacgggatgtaagcctctttctggatcgggaaaacaagacccaagccggttttctgcagggcgaatttatcctcgggcaactcctagaacgcgatgcagcaagttgtggtaacccaaatcttcatgacgcagcgcttacggtattggaagcgatcagggtggacttcattgacttcctcggtgagacgaaatacatgtatgggctgaataccattccaccttcacggtttactaacacgaatgtgaatggattgtacgagtattcgtcattcttgtgtggtgctgggcttttggaggggctagaactggcctatttgattggcatttacatctgggacacggccccggaactcacgatggtcatccatcttcacaacatgctcgagaagaaaggcttcctcgagaaaccggttgggctctggtcttctattgcgggagtttttgccggttccctatttgccaataccaaagcgccacccacttccaactttgcccaagccttcctcaaccacgcctaaaggagagacattcgagccagggccaggaacaaaggcgctgcagatcttgttggtgatctcaatcccaaggctaacatgttcttcaaaaacaaatcgcacacgcaaattctgagagaagcggggtgggatccagagagaattcctgacagcgatatcttgtttccgtccattctcgccgcccagcggctctcccaagtcaaaaggctgagggacccggcaaccggaaagatgaaactggaagagacagaattggtccgcaaagcgaagaagtcgggcatgagcgaagatgaagtactaacccttgcctcttcggtcgatactcttgcctctataaatgcctgggatgccctcaaagtccaacaagtggaaagatgcatgcataatgcaccggagatggcaggtttggccacaaaccattccaggaatacaggtgagacgacgacagactacctagaacggtcaaagtgggacgttttcacagccataaatagcgacgtgcccgtcatgggactgagtttcctatggcttaccaccgttgcctacatgtttttcatttccatcgaaaacgagctccgcgaacagcgaaatcccttgtacgtgatgccgtttgagaatgtgaagtattccggagacaagcgaatggctctggtccttagtgctctaaaagaagaggatgaggagtgcttgcgcgtgatggccaatgtgctcgaaagattgcgagccggtttcgtttcgcacttgtactggaaggatgtggaaacggttgaggaaaggctggatagaatgcagaacagggaggagtctcaaagtcctgaatgtatcataatgtagctggaagacagtataggggatacgctgggatttcctgcagcctttctcattctagtccaaatggtgctgcatctttctctaaatggtcagctactcatcaatgacctgcgatatagcatggcacatccacactagagttcagagtatctatagtcccatcctatttactccctcctttgtagatacatcatcatatatgttatttggaccgccgatgtaactatccagtgcctaatgtctcgatatagcgaccctgtctaacgacggtagactacagtcagagagcatacgatgcatacgaaggggaagctgccgtagggccatgcaacaaacaagacatcatcgtcgagaaggtcgtttatgtcagcagagacggtggtggctggccattccgagtgatgttgacgttgacagtcttgaaatcgatgtcaggcaccctttcagttccggcgacttgagagacgtaagaggtgggctctgtggggttccatgcgccgtaggtaaagggggtgaggattgggcccatccctcggaccatgtgtttgatgacggtggatgtgtactggcagtttgcgaggacctcttcacaaaagatctcggcgcgcatttgcaggcctcctctgcgaagagagaaaagggggcggaggcggtatgggcccaaccatcacccagggataaatttcccaggcgtccgagaatcagcttgccaccgcagcccctgcatacagcatcaaatgcaggagtatgcatctgtaagcgaccttccaggccccggccaagcgactcaaggctgcatggcaatgtgaccgggttcgcatcttcttgacgtttttggacaatttatggcatatgtcatgcaactatgggctttaccatgttcaaacaaaaactttgtatttcaccttgtcgcctttatacgcgcatgggataaggagatgggattttacaattgaaagacccctttaaatcacagcttgtttgtatacacctcttacatctaggtcgaataaaagtcaagtcggtgacaagcttggtctcagtagtttcaacaggtctttgtatgggctattcatcacaaggttacagcagcaattgcagatcacatgctcgacaccgttactcctcagcttctcaaatcccatgcaagcgaggaggatgtgcctccatcaattgtatgcctcggcatatcaactgccagttcagatgcgggtgtactcggccaaatcaactacaacttgttcctcattataaatcatgtacaacgcatcgcagttgttcagactgcatgcatgcataccccttgggcattcgtaagctgcagtttcgatttcaaatagaacaatcgaggcgatggaccatgggataattctagccttccaaatttcttttcgcgttagttatgtataccaaacagggttcagcatgttcagtggatcataagccttgaaatgattgcctcattattagctacagtatcgctaggctttcagccattgacgccattccctgaactagatctctaaccggtcaaattcacatgggggcatcaaactcgagtttaaccgatgggtgcatggtctgtgaacggccggtttcggaaccgttagcacaggctagcagacacactgatctgggggcggagctctgagcggctacaaagcggaggagctctctacctaaggaggggccgaagtcgcaaatcatgcttgactataagtcggcacccatgtcaatggcccacccccctcaatggcccaccctcatatgtcccaacctccctcttttctttacgcgtcactccgcgattcctcgcgtaattttttatcccttttaataaaaataataccattcgaatcgccgatgtctgaatatcttgaaactaatcttcaattagctatccgcgatatggaagcaggcgattcgcagcggaaagccgcggcgcgatagggagtccctaggacatccctacgtaaccgtatagctggccgtaaaacgcggcaacaagaggcagagacccggcaacggctctcgaaggtccaggaagcccgtttaacgaaatggatcctaattcaagactcaatgggcttccctccgagcatatataatctaatatatattttttaagaatataattagtagtttatatctaaacctttaatactataaaataaagttaaaatattatactttcagtctagatataggtattaatatcttaaaaactctaataatagaagctatttatatagctagatatataaataacccagctatagctatagctcctaaaagaggaagcttattatctaatagtaataactatcttttctttctaacttaaagtactaattacttaattaattaattactagatatctagtaagtacttatagctataatatctaatataaatattctaatcttttagagtttaattaatacttctaataagattcttaaagtaataataattattatctaagataatttaatatagctatttactaactatatttattatatacccctctagttaattaagagcttacttatagtaataaagctgtttttaatattatagatctagtagctatatctatttagtttattactttattatatagcctatctagtacgactataaatacttatagaaaatagagattagctagaaaaaaagctatatcttaagaatagctatctacttatataggcttattataatctgatatataatttatagttttaatatattatatattatattaaattaattagagtagagatagcttttaaaaattaattatttaagttttagattatttttaattatatttagatcagggtattagtcttattagattaggtttagtattagtatattaaagtttattttaatttaatctaaaattatacttatttagaaataagaaaagttagttatataagattattagttaatttatctttataagtatagtatatatttactattatagaaggtttttattagaaataatatagatttaatattaatctaatatttatttatatatagttatttatgttgattttagagaggttatagcctctataaattagtagggttttggctgctactagcggtcataaccactaactgctagcgatcttagccactggctattagtgatacttaatatagtatataatatactaaaactataaattatatattagattataataggtctatataaatagatagctatttttaagatatagtttttcttctagttagtttctattctctataaatatctatagtaattttagatagactatataataaaataataaactaagtagatatagctactagatctataatattaaaaatagctttattattataagtaagctcttaactaactagagagatatataataaatatagttagtaaataactatattagattatcttagataataattattattactttaaggattttattagaagtattaactagattttaaaagattagaatatttatattaaatattatagctataagtatttactagatatctagtaattaattaattaagtaattagtactttaagttagaaagaaaaaatagttattactattaaataataagcttcccctcttaggctatagctatagctaaattatttatatatatctagctatataaatagctcctattattagagtttttaaagtattaatatctatatctagactaaaagtataatatttaattttattttataatattaaaggtttagatatagactactaattaaatacttaaaaaatatatatcagattatatattacctaatcttaggatatatttttatttataataaaactaatagaaaaaaaatatattatctgatcttagaatatatctttattttattatatagtataaataactatatataaatagatattagattaatattaaatttatattattcctaataaaaaccttctatagtaataaatatatactatacttatagagataaattaactaatcttacagacgttattgaccttgaatagtagctcgcggttctgtatatgtggatcgcgatctatctcattgcgaataagctgccggttctcttcagatagcttcctcggctgccctgaccgcggcaggctgttattatcaacgcgttgagcctcgcgattgaccgtagatcggatagtgctaagaggtatctctgggaagagcttatgaatctcacgatacgaatagccacatcgccttctctcgcagatccgtgtacgaacgtacggacttagctctttgcctcgaggcattaggaaaatagctgtattgagaggnnnnnnnnngatgtgttgagatgtgaggaagatgatgtgaagaacgcaaaagcggcatcataatactcaacgcgttgcaagggggtgggcaaatactaaatgacccccactgtatatccctgccagataagattccgaattgcgtacaaggcttgcgcaatgctcattaaaaccagtgcagtatttattagcaagcattttaattcttggtgtgtgctcatttcaactgaggctcgttgaccgtctcccaccactaacagaagaacaaatcagagcgaccaaatgtgcggcccaaccccaccaacacatggttgatcgtggttggttcgtgccatcggaggccgcatgtgcaggtccgtccatgcatatggcaggggtaaacaaacggccacgacggtgtttatcgactgatccaccgattttctcatgggttgtacatgtcactccttagcccactccatagggcatcagtgttcgaagcctcttgcttcgatgaccagaactcttcagacgttgtacatggcaagaaacggcggggagagatttctcataaaaaattatccccaggaccaaaaaaaaatgatcacaactgaagttgtgtggcggtctctcccgccgggaattgaacccgggtctcaagcgtgacaagcttgcatactgaccactatactacggaagaattcctaacccaccaagagtgggcggatcggctgtgggcagccgctgtagtgaggcgctgatgacaaacagggctgtttttagtttctatatacctacctcaaaggtgcacaaccttactatattaccctagacctgcaactcctcgacagtcataccgcatattgtggtttcaagcatggtaaacacttctccttagccgtcgagtcatcggcaatggaaccgtagaacctaaatatatgattattgacaccaaatataaattgaaaccccggtgctgctttttctgattttgtgaggtaagaagtgctacttcctcaaccacaattgtggggatgattctgatgctctggaaaagtttggtgtcgagtttgagtggttgcagtacatgaatgaccatctctaccatcttcagagacggataaagcacccctcttctagataatgaaaggtggtatgcgagactcccatggcgataaaatagatgccatctcttgaaactgattcttcttttggaagcgccttggaaccacacccccaacagcatacctagcttagcttctgatgtggtggtaactataaggtagttcaagggcaggtcgggcttgagtaaaccttactgctcaagtctgaatgtcgtgtagatattagcagactgaaataaaaataggcttgatgggtcggctcctgggggatactcatagaaatacttggacgatgagatcctgaatcattcctttatatgaattctattgcatgagaaaaggattgtggttttttttcgctaaaagcaaaatgacccgacctgatggcgtatcacctttggacaaatggcctatctatggtccttctacacctttggccattatcctcgcactagaatgatgaagagctggcatagctgtctaaaaatgacagcccccaacccggataactcggtcatgctgctatgaatcattttcgaaaatcaccaccattgagtgtggacagtagttgagtttttttctttgtgagataagcctttggccaagtgggatcgactttcactagagcaatgatcctgtcctaagtagcacggcgacttgtagtgccacgtttgcagttgtattggcatatggaaccgatgttgatcaagtagggtgagacttgatataacataaaaaacgaggtcattgattggcatgaaacctggatattgggaatttcaaggaaggggcaaggataagtatcagaggatcgcagtcatgtgcaatggtggcccagtatcgagctggttgtccgaccatatcatagtgttccaaacgaaggggcctcaatgcggttgttccaggtgatggtatttgtactctaaagtttgcgaataaatattcacataatgtaccgataagaaagagcttttggtaaagatgagttgttcatcggttcgagtgtttctctcccaagaactgaaactcgggatcatccattacgccaattgtcagctccctctcatgtgccccctttttcatgaaccaccccatgcggaagcgtagatcctccaatcccatgtggcctttttcaagcgaacccatgtacttctgatagttcgaaggataaattagggcatccgacatggctatgctgttaaaagctggcggtgccaagtctctcatctccaaatccagcgaccattttcctctatagtttgcccaacgcctcaatccagttgagactaaagcccaagtattgatgaaaaacgcaagtgctagaatactgagtacaaaataggtcatttgcgggctttggacgaggcggagtcgcctgttgtctattactgtcccactgagaaggggcagttctccaggatgctctgggtccgtggtagatttttcctcgagatcgagtcggtttagagcgtttgctagctgaccagcagctaagctatagctagactggatgttttccaatattatttgatccatgtttggtttgccgagatctgtctcgttcaaaggacctccacccttgtcaaatagatgctctaaccgaccatcgattccgctgtaaagaccagatcctgggccatctggattcacatctggccagatagatctatcccattgtggaaaacttggggcgggcaacgttgaatgtaatggcttcgctttggagtagtctggtttgggagggttctgatggtctacctgcagaccgttcgcggtccaacgcatatgcagtttcgtcggtatctcggaccaagtgtagttacatctccaaacggcaagatagtcccagtccggttgttgagcaccacccttaccccaataccatgtttttatcatccagcgatcggttgggcataaagtgggtggaactggaaactccccaatcatgtaaccatttttgtagtattgagtagaagggacagacgagacgttgaaagtggtgccattagggcaagggtaaatcacatctccggccagcaaatacatgctagggactttccagaagggtttgaatgtcaccgtgtctttggaaaatggcgtacactcagacgtcaacttgatagccggtgcttcaagttcaaaggtcacattcgaattccaatctcggttggggacgtcgacctctagacggggaaagatgagatcgcgatatgtgaatgcagaccaggtaaagttggtgattctctccgcaacaaacagcccccccacagcgtacctatttatcatggattcgttcagcttccccgcttcggtgtcttggacccgaggtcgagatccaaaccaactttgttgcttgaagttgatagcggagttgttggatatattttgagaagtgaataggagagacgaaaatgacaccaagaaggcgcaagccatggccaacacttgcgcaagagccactgcatatattttccaccttagcgagtaatataaagctctcagtccaagcatgtccagcagtgaaacatccagctctcttatagtacaggagcgtgtactaagagtggagtaagtagcgaggtcacggatcgctgtatctgatgaagtagtgtaaagtgtgactaggaagaaagccaaggtagggcccacagtccaccagagagatggagttccttctgcgagagtcactactccatcagatatttttgataccttgagtatgataataagactaataattagccctaaaacatataccgtaaatatcagtcttagccaggttggaaggggcaggggagattcttggaactgtctccataacttggatctggctcctctcttttgcgatagagagggaaaagaatcaaggcttttgccatgaaagaaatccattagaccaaggattgtggctggatttttatcccagtctttaaacattcctctgtatttgagcatagcccatagagaaataattgccaagagcgcagagaataccgctaagcagatacagaccggctgattgagctggagcctagcagtttcgaaaggccttgaccctattgtccggatttcttctttatttcgaagctggtggtgcgcaacaatagaaccaaatgtttgtgtgaagtccaacacagatccatgcagaagctcgctatcatatatcgaatctggagtcccgtttttgtacttgatgcgcagatcgagggattcgcgcaagaatgtattcgctagaaggtcaccccccacataccagaagtcagttcttgctccaacccaccgctctggggttgaaaagtatggtctggaacctccaaggtcgctgggaatcgaactccaggcgaggtcatatatgttagttattatgggagtcttcgcttgatcttgtggtattgacatgctagggtaattcccatcatccacaatatccactttcgatgcccaagccgtgtgcgagcaaagaacggcggcacaggcattttggatagggatagaactattttctggcgagggtgtccactttgctgccatatatacaaactgctggaactgctggggtagcgcggagcaattctttggggttgcgaacacttgccagatggttgcttccgaccatgggtcaccggtggcggtatcgactctcacggatacgtttaactggagtggctggggacagtctccaaatttgagatcgaggcgtaccgttgtatcgttttcccggcccttgatggtttcgttaaggggagttgtggtataactctctagttctcggcattccatatcgaagaataacccgtctactcgagcagtgatgggcgaatcaatagtgccacgagcgtctttgttggccgttgctgcatctgtaaaagtttgatatagtgagttattcccaaccccgaagggaagccctgtgttgaagtcccggatcgcccgggcgttgtaatagccattagctataaagttttggaacatactatggttacccgtcccgaaagaatcccagatttgtatgtcaataggcctggaaacccaaaaagtcctcaggtagaacaaattaggcatgaggacaatctggactttgagcaagattgtggtgagcgtgatgataaacaccatgaaatgttttttacgcaaagactggaccaaaatgattggtgatatcttggatgtataatccaactcatgaaagtcgtgcgaatgttgaggctgcacccaggggaagtatctcagagtctgcaactcgactctgctccagaagactgtgacgagggtgaatactaatcaaagaatgttagtctttctgacttgatggtaacaatgagcagacgagagtatatgcacctaccggcagttggaccaaatctccataattgttcaagatcccttcgcgcttctaaaagtccattattccggtttgatattaccaatattaccggaaggaccacgacacagcacaggaagaagccagaaaatatcccgagtatggacggacgcaaccaaaacggctgccatttctcgcttccatccccttccatgcgtactggggtctccttgggacgtaaaagtttcgaccgagtgtcatcaccggaatcattcggcctcgtattggggatgaccatggtttgtgttgaagaagatgtctcagtggcatagccatcgagcacactgccttcttgatcgcggtcaacagaccaaggggtcgtcctggaatggtccatatcactgttggcgaagctttgggtagtttgggccgggaagcgcctagagctggccaacctccttggcctttgtcggttttgtcggtcttgtcggcctccgttgtgtaagagtagaagctccgtctcttgacgtcggtgtgtcatgctgggagttatttagaaccataaggacgcttctcacttgtgggttgcactagtggtatctgacattgagactgaaattgggggttggctgtttgtatatctacttgctcttctacgactcttggcggtgctgttggctcggcatatcgtaattcgccgcttaagcaaggtacttccctgaatgggcaaaaggtgactgttaagcgccaacgctgttcattattacgggtcatttcatgcgatcattgggctacagcttggaatgtctgatggctggaggaaatcatgtgggcggccaagagtgtgcattaggcaggattctgcaacgtagaaccaactgcatattctgaaccttgtagcgtggtatattttgaggctcagtgacatccaactcaggaaaccgggctgaccaacggcagaatctgaaatccgcccacattacccgaaacagctgagcttgctagcttctctagccggcagctaggccaactgccaaccaaagggcacgatttgccgccgctaagagagcagacgaagggagcatccaccaaagagtgcggcgttttgggcgggcatggtgggcgaactaggctggcacaagacacgcttttgtgctctcggatcgttagattaagaagggaactgtttttacagcgcgtaaacgaagttatgcctgcgttaaatttaacccacgatcatctgatgtcgaatacccactcagagaggcagattgaacagtgacgctataccccacccaaaggctaatgcacgtcgctagcaaatgagggaaaccatgagcttgaatctgttccgtttggtcagttggcagctgagaacttgaagctagctaagcaggaaaagtgcttttctatttggagaaaatacatgtaaagagtcaagtgccagacaaactgatgaattgtacttttaatcaactaaagcctcagccgtgcccatccagacaggaccgaaacacacaccacgttcccggtttgtgtatgatcactaatggaatgcctgtgatgcgcttgctactcaacgttggctggactttggggtcaatgccagacagaacaaaaaaacccttgagcggacgccgtacaccataacttccccatttgcaataggctatagatctacactcattaggtacatttccaagattctcatgaacttagcaacgaatgcctcgagatgaaagatgacctttgtgcccgtcttgacccgatgctcaaagaaagctgaccagtaaattacatcacccttgaggccatcgtccacgagggctaacaatttaaaggtgagagttttcaggatcgttgttggtgggatgcagtgtgttaacaaatcatacaatttggcgcggacttgtagtatccggttaggagtgtgctcttcgataatttccttggcaatttggccaatgagagcttcccagtcggcgggtgggattggggtgttgtctgaaaccttttcactgtcgtgggagaaatcgggtatttgattagctttcaatgcaacgttatggccatggagtttcttaaatcatcttcacttacttctgggcatggacggcttcgtacatgaggagcgcccttcgcagattgcgaccactttcaatggctatccgctgatggagcccctttgcaactggccagttttgttttttggcagattgagcgagaacgtcgcaaatctgttcgtgtgttggcgctgctactcttaccagcagcgttctggaccgaataggagcgatgatattcgcagtcgagtttgctagaagaatcaatcgtagattgggcgagtatttctccatcgtacggcgaagggctgcttgggcgtcgcgtgtgagatgatcggcttcgttgatgacgacgaccttgaaccgttgcttcgccgactggtcgacctgttgggtttgggcgacctcctttaacagatcctgcacaacgactctgtcataatttcccacatccgaaggcgttatctccatgtggtagatggacgaaacaatgttgaactcgagtttgcgattgctggatgtctggaaaacacgggcgtcgatcttgatcttttccacaccgggtccgtatagctcctttagagtcgctactattctcgtcttcttccctgccccagacgggccgtaaacaaggagatgtgggaaatcgctgctttgcgcctagtaaccggttgggttagcagacggtgatacttgactcgatgtgcaagagcgtacaagagatctgaggcgttctgataattcatggtgataggtcaatgtatccaatgaccgtggccgatgcttatccacgatgagagccatgatcgttgattttgaagttactctctggtgatgggtgagctcaattaagctgatgggtcaaaatcaaaaagatgagcattctggaagacgcgtcgatcgcgttaagtggcaggtgcacgggcatgtcgctttctgtgagtgcacggaccaccgtgagttgcctgaaggtacaatgtacatcagcgacccacgacatgcgacttgtacagccgcattgcctggaatattacgagcaagtggccaatttcatgttaggattgggagaatgtctaaaggctctggcaatcttcaaaaacggtgtacagtgtaaacagtgtttgtgagacctgcctaaatatttacatgacgatgctttctttcgtaatagtggttacactggggtcaaattgaacccattgaatacatgattatgcgcccaaggatcgtatgtcaaggttaaaatcctcatgaaaaacaatgctcagggcgtctttgaggggctttctgtgacctcaggctcggcgggagttccagccaactcagttggtaccacccttcttgggcgttttaactcttcgagggtcacaccatccaacttcgtgatcccgacgactgggggatctcccttcttgacaaactcccattggcctgtcaaaaatggttagcgatgatgtatattggactttggtgactatactgacctggcagcttgtttcccgccaggcggaaagcatctcgaacgacttgctcgtggactttgcccctgagctcaaacagaacctggctcacagccattctagttgcccaatgatcaaacgagcccttacccttacccatacgcatctgatttgagaaacaggttagcctcgatattccacagtttgacctgccctgaaactcacatcgttgccgctcgcgtagacgccaacattgcagcacttgcgcttatacaggcggaatctctctccacgtagtcgggtcttgattgtgtcttcggccatctttaggtgctttgcgctgattctgcgatcatgatcgaccatgcggattccgaaatcgccccagatcactgttgtgcctttgaccgagcctccggtgggaacgcgggggcgacccttggccatcttcttcttcctgtcgatatttggctcaagccaattgccgagggccggagtcgtggtcgagaaagccctggcattttggagttgctgtgtctgtccctggatgggggcccgaagtaggcgcaaaggtgcagaggttcggaggcccaatgcctggaaaggcccgagtagtgttgacatgttgacgggcttcatcgttcgccaattgtcgattgggcaccttctaggcagatagcttggcctctgtctggcaattggaaattcttctcaaggtgtcgttggtgtggggcgcaaatcgaggcctgactggccagacctggagggaagttacccacttctctcagtgcggcgactgctgccttcaagctggcaagtacccaggtacacctgatctcttaagccggtcacgcatctcgcgtcatcttcgcgtctcaccaccctgctaatcaaccaagtctttaacgtcactcaactggttgctgcctgcattcatctcaacaagaattcctttaatacgcagccacgcgccaagctcggcttgtgaaattggcttcccttgaaagatgcaacgccgtgggctctgttaatactactttggctttatacttctcaattatccgttcacaatgcctgacattcgatctttctttggccctaagggcggtgctgccccaaagcctacgccgaagccgccggcagagaccaaacgttcaagtgagaaattcagacaccgaattccttgatcaattgcttacatattttagaaaaccgaaaagttattgacgagagcgatgaggaggaggttgagtgcgttcgacatcagttgttcagatcgcttcgagacaatgctaacactatgggcagacagaagcgaccagagccgaaagcttccacaaagaagaaagcagggtatgttcgtgtcattcaaagaaaacacttggtttctaactttgaactcctagagatagcaagcctgcaggcgtatcaatttccgccgaggattattttgcctcaaccaagacaaatgactcttccaccacacgatcgacgacctcctcattgaagaaagaggagaagaaaacagacgttcaggtcagatcaagccctcgaggaaggaacccaccctcgaaatcccaagctggccctgacaagagcgcctcacctacgaaaaagcgaacggctatcagttatactcgccacgcagccaatgatgatgaagacgcctatatggatgacgccgatgaagatgctgatgatatcttcgcggctgacacaaagggtcgtggcaagcgcaaaaatgacgattatgtggaggatgattcggacgaagatgttcttcctcaaccgaaacgagtggcatctcgagctcgagcttcggctgccggcagtgcgacggacgagaagaaggcatcaaagccctcagcggcgaaaaagcgaaaaacccctgagcctgacacggaagaatctgaagatgaggcgccaaaaaagcggaagacccctgcgaagccacgagctccgcggacgaaaaagccagatgaacccgaagatgccgaaattcaagacattctcaatagcgttacgacagttcgagcaccaacgcctccgccaaaggatcccaatgctaagtttgactggagaaaagcaaatggtggtggaaactcagctgctcagcctatgggaggttcggcagaaataccagatggcgaagaggaatgtttgagcggcctcacttttgttttcaccggcgtattgcaaacaattgctcgagaggaagcgcaggcattggtgaagcgatatggaggtaaagttactggacaacccagcagcaagacaagctttgttgttcttggcgaagacgctggcccaagcaagctgtctaaaattaagtcactgggaattaagacgatcgacgaaaatggattatttgatcttatacgaaaactacctgccttcggtggctcaggtaaaggagctcaaaaggcgcaagaaaaaaagaaggcagatgaagaaaagatgaagaagcaaattgctgaaatggaagcggaagagaaggctaaacaattggaggcagcgaaggcggcgaaaaaagctgccgctgctcgaggcgtcacggacaagtcggcggttctcccaccagctcccgttgcccaactgttgaccactaagtacgccccaacgcagctaagccatatttgcggaaacaaggggcaggttgaaaagatacagaaatggctgcagggctgggcgacggcgaaaaaatacgatttccaacgacggggagctgatggactgctcggagctcgtgctatcatactctctggcccgcctggcatcggcaagacgacagccgcgcatcttgcggctaagcttgagggttatgatgttttagagagcaacgcgagcgactcaagaagcaaaaagttagtcgaagccggtgttagtgatgtgatgaacaacacctcgctcctcggatactttgcaggtgatggtaaatctgtggactcgacaaagaaaaagattgtgctcatcatggatgaggtcgatggcatgtcagcaggtgatcgtggtggtgttggtgcgttggcaaagttctgcaagaagaccgaaatcccactcatcttgatttgcaatgagcgcaaactgccaaagatgaagcccttcgaccatgtagccctggatataagattcaaccgcccaacggtagagcaggtcagaggccgcatcatgactatatgccatagagagggattgaaattaccagttcccgtcgttgatgctctcatcgaagggagcaacaaggatatccggcaaatcatcaatatgatttctacagcaaagctcgaccagaaaagtatggattttgataaaggaaaggcaatgagcaaagcgtgggagaaacacgttgtgttgaaaccttgggacatttgccaaaagatgttggctggtggactatttgcaccagccagcaagtcgaccctcaatgacaagattgagttgtatttcaacgatcatgaattcagcttcctcatgatccaagaaaattacctcaagaccaagccaatggccttgaatggccaaggctacaacaaacgacaagaaaagctgaaggctttggaactctttgacaaggctgctgagagcatcagtgacggagacctggtggatagaatgatccatggccctcaacaacactggagcctcatgccaacacatgctgttttcagcacagttcgacctgcaagctttattgctggccaactcatgggctcagacttcacaagctggcttggaaataacagtaaaacagggaaactgggacgctacacccgagagcttcattctcatatgcgtcttaaatcatctggcgatcacaatgaggtcagacaggaataccttcccgtgctctgggaccaaatagtcaaacgacttgagcgtgacggcaacgaagctgtttccgacattatcgagctcatggatagttattacctcacccgagacgacgtagacgccatccaggaactcggtgttggttatatggatgagggtaatgtgtctgttgattcaaaggtcaaagctgcctttactagaacgtaagtttgctcatcaccactcctactgaggcactccaggaactttactaactcttgacaggtataattcaatgaaccacccagttccattcatcaaagcaagcaatgtcacagccccgaaggtccaggccaaggaagcccctgacctggaggaggctattgaggaggaagatgaagccgaggtcgtcgaagctccggaagctgatgatgaagagcttgatttgaagaaggacaaatacatcaaacaacccaaggctaagaagccggcgaagaaagcaacaaaagccgcggccaaacccaaggcgtcgggaacgaaggggaaaggcaagaaataaactggctgcatgcgcttcattgtaacgttagaagagtagtaatcattttggggtcagacatgtattttgctattgacgggtatataccgattgcttatcacgatatgttgtcaagaccttcaaacataagccacctcgtccaaaaatttcggccaatatcctgtgaaaacccaatactcgatggtaacgatcttggccatctggaccaagtctaccccctgttcatcttcatctccatcttcaccttcacaagcgtaaccagaaccggaagaaaacggatggtattgggctggaaatcttggagcctgatgttccatcccgaggggtccaatggtctcgaggcgaagatttgtaggctgatagttctgcgagaaaattagtgaatacagaagatcctagatatatagactaggggaatggttacctgcagaacctggtcaatgatctggtgcgtatcgtatcgtcggcggcagttctgagtaaacagtcggaacgtgcagggcgagatccggccgtcgtctggatgaccctcgtcatcagagataacgaactcatctgggactgatatgttagtatatttccccgaagcctgatattgatcaaatttgacgcagtataccttcttctggaagagcaatgccttcgatattcttgtctccctgatctgaatacccccaattttcagagtctatgcataagttctcatgtccgattcgtgggacttggtattgtacagcttgagggttgtgtgcaagtatgggatcggcggctggagtatcatgagattgtgaagtgtccggattgcgaatatgctcatatggcgctcgaggaagacagaatacatctttcctccctggatgatcgtctggggagggctgttcgctatggtacaaggaattgacatcagctaggatcctacaatataatcaatgttagttaaatatacgactttctaagtctgcaaaatgtaagaaaagaagggataagagcgggtggactgaggttcctaattgtgagggcattaactcactcgtcataagtaccctcgccctcatccatcaccaccttcaggaggttcagttcttggcatcgctccgcccagcagtagacatcccgaccggcttccctgaaaggcccgcgcatagagttataagccattagagtagagtttgttaggcgccaatgtcgagacccggttggcgcagtgcacccgggagccaacccagcggcagcaccgtggagagatgaatccgaagaatgggatgagtgagacaagcttggcggaggtaacatgccatcggcatggcattgcaatgtctcctcatcgatactcgtggagcttgagcttcctataacggggattggttggcgagtctggccttcgtctaggttgagcagagatatttcggtgctgggagacggaatgatgctgtattggccgcgtcttttcaaaacacgtctgggtttgctcaggcggggttcgtaatcctccacaccgtcattggaatccttattgaccccgggttttggatcaaatcctgtatggcggtgagttggagggtatggaaaaacaaatgtccccatgactggggaatgaaatcggatgcccagcatttttagagcttctgtattagacttggacatactcccgagcgactcatcatcaccccccaggccgccgaattccaagtcgtcaactttctctatgccatggtggttctgcttcatgatcggcatgttttctccttgaagaagtgtggccgctgtgttcatcgtggtgattccatcgcaattggggaattctactgctgattcgcgccctgagtaatcattagaaatgtattgataaacattgaaatgaaacaaagaaaggttaaatcggagaaaaggcaaatgatagctcactgtctctgattctcagcgaaagcggattgagtctggggactctccggactaggtaagtaagtgagtctgtgttagtccgtcgcaaacggccataagagccaagattggacccaaggacacatagaggtatacttacttgtcttgattggggtagcttcgtcttctcttgtttcaacatcctcaatgtcacccctacacgtctcatctgtgctcttgcacgttgtggaaacaccggcgcgagctctccggaaacgagggaggcgaaaacaagccattcccgaggggataggtaaatgtcgtatgtgaggggcgtctcaggccatatgtattgttcgttctttgaaggtgtgcattgttgtcggtaagcaaggggcaacaggagagaggttgagcacgggcgagagcgtcacgagggacaagcaggatgtggtagaaggagggcctttgtttacatatgagcactgtcgtgttaacgttagcctgctcaggcctgcagaacagtgtgtctgtgtggactcggcagatgctggcagttggcaacagttgtcaaatcgttgccacagcaccgtcggcggccatgtgtagctggcacgcgatgatcaagtccctatgaacaagtaaatcaagaacgtcgagaaatccaatatagctcccctgttgccgtttattagtcacgtatgtgctcaaaagagtgaagagttggtggggtgttcagcgaaacctcgtgctttggtcctgttgggggccgcatagaggtttgttcgtgtttgtagattagagagggagcgattctcctcccgagatcagtctcgcgcataagccgccagccagatgatataatatacatatatacattgtttgtcccattccgaataaaatctggggtcgtctcgtccaagaacaagtctcgtctttgcttatgatcaaaaccgccgccatgcaacaacattgaaatcatctttttctttcgtcaacatgagaggagcattacacattttgatccaacgccatccgtttttttttggtgtccaactaaaattacaacaggtgtgacttgcacacttgtgccttctcgggtgggaggctaggtgtttatttgttcttgacaacgccaaccttggctgcgcggagcactcggccgttgagcttgaagcccttttgctgaacaaagaagacggtgttgtcgtccttctcaggctggggtgtcatgaaggtagcctcgtgctcattagggttgaacttctcgccctcggggctgagacgctcaagaccgtgcttctccagagtctgcatcagcacagtctcggtcatcttgataccttcgtgtaggttgttgagatcttggttatcagcattgagcttctcgggtgcgactgtggtcaaggcacggtccaagttgtcgacgctgtcgatgagatccttggcaaatttctggatagcaaagtcgcgagcgctcttaacttcacgctgagtgcgatcttgaagattgcggaagtcagcaacggtgcgcaggcacttgtcctgtttagacattgtcagcaaatgtaccttatttgaaaaagacaaaaagtaggttgtgtacgaaccttccattcccgagcttcggcgtccttggcttcaagctgcttcttcagctcagcaactgggtcagcctcggcgcttgcctccttagcctcctccttagtctcctcagttttggtctcctttgcgtcgctgtaccacctccccattgcaggtgtgaaatgtctgggagaggccgcagcgacgatgcggaactgtgaggggccaaaggagctcgtggctgccattctgggggcggtagagcgcaacgcccgggaggaggtggtgagtgcgtgtcggaacatggtgaattaaaggtgttgtggcggaattgaggaaatggaaagacggttggctgtgaagcttgggatgagctctcgagtataagagcaacgggaatggagtctgaaatttcatggatgcgcatgtgcctgctgtagccggcaaagcctaagggatcgggaccggtaccgcagggctcgcggccaaatgataatccgggcaattaaccccgatcgggaagcactagccaacccagagagcttgacagagccagcaagaagcagcgatggtggggtaagtacgacttgcccggccgggtcctggtaggccctggcccaggcaagagcgagcctggaggtacccgcgacccacttgcctacgtcgctcgtgcggcaacctagagcacaggcaaacaaatgctaccgcagtgcaagggcagagcaacgaagtcgttggaagcttgactgcatcatttcgcaccgtctcatcttcaccacaacgcatcccgccgtcaccaccctgctttcccgcatccccagtcccgggactcaacgccttgaacctacgatataatcagtcgccccttcattctcagcagcctcaacaatggcggtcggtgactcggaccgtgtccaagaagcccagaagctcaccaagaccaaccctggcaaagcagaggccatctacagggaaatcacatctactgcccccagcgcagcctccgattctgcgacccgagaatatgaggttgctctgataagcctaggcggtctctacagagaccagacgttggtttcccaatctggtgatgcaccgggcgcttggatagctgactgatatatctataggcggacacaggacctggtcaaccttgtaaaagagagtagatcagtgttttcctcctttgcaaaggccaagtctgctaagctgggtaagtttgcagtctagacgttgcccgcgtgcctgacctatacatcaccagatgctgacacacgaccaactcctagtgcgccaactgctcgacatcttcagagacattcccaacagtaccgacatcgagattgctgtgactaaagattgtatcgaatgggctacttccgagcgccgcgcctttcagcgacaggacttggaagtccgactcgtcacccttcacatgaccaagctatcttggtacgatgcgcttaccctcatcaatggacttcttcgcgagctcaagcgtctcgatgacaagctacgcttagtcgaagttcagctcctcgagtcccgagtctaccacgcccttggaaacatccccaaggcccgcgctgctttgaccagcgcccgaacaagcgccgccagtgtctacacccctccattgctgcaagccaacctcgatatgcagagcggtatgcttcacgccgaggataaggacttcaataccgcattctcatacttcatcgaggcgttggacggataccacagccaggaggagagtggcaaggcgcaggcggccctccagtacatgctgctttgcaagattatgctgaaccttgttgaggacgtcaaccagctcatgtcatccaagcaggcgctcaagtatgctgggaagaacctcgaggccatgaaggccattgctcgcgcgcactcgaatcgctccctggaggagtatgagagggctctctctgcctaccggtacgagctgggcagtgatgctttcatccgcaaccatcttcgacgactttatgatgccatgttggagcagaacttgatcaaggtcatcgagccattctcccgcgtcgagattgaccatatcgctaagatggtcggtcttgatacgcagcaagttgagcgcaagctatcacagatgatcctggacaaggtcatcatcggcgtcctcgaccaaggtgcaggatgcctcatcatcttcgatgagactcatcgtgacgaatcttacgacgctgctctgaagactattgataagctgagcaatgtggtggatgcgttatacacgaaccaggcttctctgctagagtaatatgaacaggctgaggaaaatagagacggcttggtcgtcatggcagaatagattcaatgttcagtatagggcttatttattcaagacatgagaaagggaaaggatgattccaattctcgcattcatgatgtgatttgtttcaacgctctgtcgttacttcgtagtctaggtatgtctgacaatccatccatcgtaacaagttccttacccaaacgaggtatctcaagaaagtgaacctaaaaaaagaaaagaaaaacaaatcgaccccaacagtgattccgaacctgaaacgccgcctgatgcaatttaaataaggcgaagcgaagaacaactgggaagaggaaagaaactaataaccaaatagagggcacaagtgccttcatccactaacgccttaaccatcaagccgcaatttttgaggcaacgcatgcttttttcctttcatatgtgtttccgccaattttaaactcgggcttgctttttcccctggactccgtcatacttgtagaataaatataaagataaaatatagagttgttttgtatcaatgaaacatcattgctgagggtttcgtcgtgtgaccgcgcattctccttctttcttccgcgaggatgagagaaaagaggcgcttggcaaggtcgccctcgtcccagccgccgacgacggctcggaaagcgtcgacacagtcaaggtgccatcgctcgagaaccatggcctcgccttggctcttgactttcttgccgagatatttctctgcacgacggggaaagtcgacttcgaagtcacctacgaggcgccgctcaaggatgcggtccaggaacaaccagtgttctcgagtccagactgtcggtgagagcttcttcgaggatgaagcagagcttgaagactctaccctagcactagccgtagatgggagattggtttgccgttgcttcgggaggggcgatgcatcggacattgagatgtcggaatcatgattctccttgccctcgataacagtcaccggctcctctctactgactggctggttctgcgtgacagcagccagggccgatgatgatgcattcgaaaggcggcgctcatgacgcgctcgagcctgctccattggagagagcacgctacttgtaaactcgactacacgcccgggtgtgtggggtttcaagggcgatcggaggctcgacttggtgggcgaggcattcctaggaggtagaggccgcaaaagactgcggccaaggtcaggagaactctcgctggcattggatgtctgttgttgccaccgctgaatgtcggcatgagagagttgcatcctgggtggcgtaggagcagacgaggagggctgaaaaaaagactggctcggttgcctgggacggggtgtgaagttttgcttctgagctacaataggcatctctatcttctctggagtggccggtgatccggattctgggccagcggaggccctttgtggatttgacatccttgatgatctgaagggtgaagagagatctcggcccaacgtactgcctaaattgttcgtcttgtgaacaacaggagcagacgacgatctcttatgagaagagggaggtgctgatgacttggagggcgacgtcagatgcctggggctctcgctctgttggcggaaaggatttgaggcgatttgagggaacatagatgttgtcgcgatggcaggagcatgggcagactcggtttgcatggagtttgaggccccggtagcggaagttctagatggaaacaacttgttgaccagtataccggggatggctgcaggcgaagaaaaaaatgaagacaagtctactctgctttccttggctgaggtagctggttcttgggctccttcaggtgccgccagtctttgggtcagtagagaatattcttcggtctcatcagcttcttgatggacttggccatcggtgtgagcactggtgtctctggttctgccttccgaggcttctgcaggttgcgtcgtagcctgctctcgtgaccaagtgctttgttttgtccagggactgggtatcgttccgcgacggtgagaggcagaaaatacatccgtcgacggctgctcaggggcaggatcaagtaatgatcgttctgcttccacctcccatatatcagtctcatcatcctgctgagacaactcttcagcttggtgtaggtttactgcagactcttcctccaattcactttgagggttggggggttggtcagcgagtgtcgaaggtagccctgcagcctctcggagagtattatcgcctctcagtctcgggctgattgggccttcgtttgctacccagctcatcccatcatctggaggagtcgctcgcatcgagctacttgttgatcctgacggctgtggtcgggacttgtccggcgactgctgccgactcatactccaaccaagagcttgcataaagctggactgaccagtgttgcgagatgccgagatgaacgggtcatcaatggaagccgattggcgctgatgcccgatagaccggcgcgaagggcttatcatgttggaacgccttccggtcgcgctctccctagagcctgaccaagagtctttacttactgagctcctgaaagggctgccaagttggtgttcttgaggttcaggtgatggaggatccgaagtaattgtttggagtgctctgcctgcacggacaatggccgaaagagcaggcctggctgctcgctccatgggagactccacagctacagactgtggctcatttgctggcgaggaaggttgattgacaggtgtgatctcaattgagactgccggtctttcagcaggaagaagctgttcattcaatggttctgatgtaaccgaagacgaaatgggctgattctcaagctgaagctggggtaccaaaggcgaagagggcattgcttggtcttcgggcttattcaggtcctcgctgggttcagcctgcagatttgggggagtatcatcaggggttggtagacgatctgtctgtgcagcagagctagcatttgaaggaggaggtaattgttgatgtgaggggtatggattgtcgatatgtcgatactgttgttcctctaattcttgttgatccggaagttcatcagacctcagcgcctcggccactgtaaggtcttcaaccggggtagggtccctggccaggacatcatgaattggctcaacttcaacttcctcttcctctaactcatcgatgaattcaacttgatcgatgccatcctcttcctcgagagccgggtcttcgggtgctcgttcttcagatgctggctcctcaggttctggaacgaacgcggcgggtcgccgtggagtcgctgcctccaacacggtctgcggaatctctgagaacgaatcgtcataatcgtcatcgtgagattgagtaatgcgggttgctgaaggactgggcgatgcctctggcgcagtaccttccttctcagaaaccgctggtgtggcatcaagctgtctagcctgcgatttcaacagacgttgtcttagtggggaaatgttcggccttctcaggccacgtttcgcccactgaggcgacaacaggcgatttggcgaggacacaaaggctggtgaaaagacaggtgctgtctcatctgaggctaactcatcttggtcttgtgccacggagggagatgttcgcaccagttcaggcccggtattggtgtttgtctcaggcgatcttcggggtaattcttgggtcatgtgagcctcttccgtctcggcgagctccttagccctttcatcctgctgctccggctccagctcctcttgagcttgctctgcaccctcttcatcttcattctgttcttcttgccgcacagactgccgtagagactctagagttttgttgatgataagactggcttcttcgtcgatatcactgtctggtaaaggtagtggctgtcgcgggccggggacagagcttctgaaatcctggaatgactgtattgattccataaaaatcatactaaagtcctcgccttgagcaatggtgtcaccgttgtccggaacagcgggatgccgcgattcaaccgcctccggactagcagtagaatgagactggatgccggggctaggactgggagcccctccaaagtcattgttttctgatgctatgctctcataatcaatggagggagagcgacgagagtcaaccgggtcgagagctacaggctgtgcccgggctcgaggcgtccgttcaggggacgcttcattcatccacatgtcgaaatccgatgctgggtctgctggcgcttgtgtcatttcgatatttgaggcagtctgagactgcggttcatcagtaaacgcctcaggcggcggttcaataagatcgatatcattctcgcttggcatggcttctggtaggactgccgcctcttcagccaactcttctaattcccctgggattaaagcttgacgtcgcctcctacccctccgccccgatgcgatttttgtagcagattcaataccaagttcacttgaaggctcaaccgtgtttgttttccgtggcctgccacgtttcctgggcgttggtgttggttgaacgacaggatctgataaagggtcaggctcgttaattgtgctttggcgccgcggcgtcctttgcttaataggagtcccggcctttcgtttttttgctgcgcttggcattggcgtgccattcgtcttgcgtggacgacctcttcgtctgggagttgccatagaatctaatgtgagatcaccctgttcgtcctctatcgattggcggaggggcactgtggtcgtcgtcgtcattccaactccaggccgagggttccggaacgggctagatgatgggaacaaccgccgtctcgtagtacttgctggattgccatcctctgtttcaacagtgaccaacagtcgttgcggcgacacgttatcgcccacctctaattcgaaagtctgtttcctaggcgagcttgcgagagatgcgaacctggtagagcgctggctccgtgttacgcgacgcgaagacgggggcatgatcgaagtcattgtgtcgtcgttgagggggtcgggggacgacatgatgtcgacgctgggtgttgccggatttgcgatggagtgccagcgtacgctgaacgactgagcggcggcagaagaatcccgctttcttttcattggtgaaagaaggcgggcattcagacatggaaaagggatgcgcggtaagacagtccacgctcgggagcgggaggggggcgttgagataacaataacgagttgacggtgttcgtgatcgcgacgagctctccggtggcggtggcacgcacggcctctgacgggtgcgtgggtaggtacatgcccactccggcgcggcaggagtggacttcaccgacttgctttgtttactcatgaccaggaacggactagcggatttcagggtcgttttcgcagtttctgtttttccattgccgagaacagtggtcctgtcgttacataagccgtggccagcgcttcggagaatagtgtatccgctaccccaccaatctcctctcgctgtggcgtcacatgtcgccgtgacaggcagttcgagtgagaggccaaatgtgatcgcgtggagtagtttcgctgcaaggatctccggtgtgtcggtacaaagtggccaaaggacctcggccccaattgcctagccttgaacggggcgttcaatctcatgtcgtgcatctgccagtcggtccctcccttcggtagcagagacatatatcttctcggtccctgtcgtgtatgtcggacgaggaagagacaaattccaatcttttgtgtcggctagtttccccgttgatacacccgggctccaaagtaatcaggctagctttgccgaacagcgactcacttacaccccaaccaaccgcaatccacccttttatcatcgggttaatttaaaccctcctcgcccagtccttgtctctcctctcacgctcagattctatcgcgggttgtcaaaatcataagtcatacagacctgaaaatgacttccaacgcccccattcctcaaaacgacaatgtcgcccatgcgctctccggcgcgggtggtggaatcctgtccatggctctgacgtatgtcatcatcagtccctgatgcgactcactcatgcaaccatcccttggcaccatgaatcaaaattgaccgacctcaccagatatccgctcataacactctcaacccgcgcacaggtggagtccaagaaggctgagaccaagttcatcaatgccgtccagcagatcatcgcccgtgaaggtgtttcgggattatacgccggtattaactcggccctcttcggcatcagcgtcaccaacttcgtctactactactggtatgagtggaccaagtccttcttcgagaaggccgcagccaaggccggccgcgccaacaagaagctttccactgttgagtcgatgattgctggtgccatcgctggatcagcgactgtcatcatcaccaaccccatctgggtcatcaacacccgggtcacaacccgacagcaggggaaatcctccgatgttgaggccggcgccggtgccgaggtcacgaagcccaaggccccaagcacaatcggaacgctcctggcgctcctgaagaacgagggccccaaggccctcttctccggtgttcttcccgccctgattctcgtgattaaccccattcttcagtacacgttattcgaacagatgaagaatattgtggagaagaagaagggcaagatcacccctgcgacggtcttcttcctgggcgctcttggcaagctctttgccacgtctattacctacccttacattaccgtcaagagccagatgcatgtcgcgagctccagtagcaagaaggagggaaccttccaggctctaaaccgcgttatcaaggaggaaggatactctggcttgtacaagggtaagtattgtcgttctctacttacattcaccccacgcagtcttggtcattaactggtcggcacaggtatcggtcctaaggtcacgcagagtgttttgaccgccgctctgctgtttgccttcaaggatgtcctatatgaacagaccgtcaggcttcgcactaacatcgctcgcaagcgtgttggcgcgtaagtcgtgaaacttcttaggtatgtattggtcaccttgacccgcagctattgccgacagcgtagccgtgtagcaagtggccaaaggtctgaatgcatggaccctggatctcgctatccttgatgcattgcggccgataagagtgtagtttaagactgataaatgaggaatcttacgtgcggaaacgcatgaaatccttggttttcggtcatgtgcagtttcaccagcgagagaatatggaaacgcaacctagaaagttgacgttttatgtaatattcatcaatattatacaagattagtagaagtctacatacccgtgtacattatggaatggtaatcagtttcggaacaagccaccagtcgtgatacgccttgtcgggagttggtatctctactttgaatctcacatcgaccttctcgcgcttttgcagtgtcgcctgtagcgttttgacagccaatcccgctgcaatacacgatttcagcgcgttcttcgctgtatcaagccaccgttcatgtgatccaacagagaacgattccgtgggtggtagcctcgtcatggtttcgaaggcccttttagcacccatcaacgatctgtcacaatactctagaatgtcatctgtgcttgtgccctgctgtttcgtgcctgctgtaaaatcctcaaagctcggaagttctggtaagccaatagacgcaaatggtttcatccgcagctcataccgcagctcatcattgctatacggtcgcccagggggtttgacgagccccaaccgcgcgaggacagtgtagaggcatgacagggcatctgaaagttcccatgtagcagctgcgtccaagagtgagaggcggatgaaagagagcgaacgctcgagttgcctgatttggggcccagcgtgactgttctcgcgagtctgcagtgcacggatttcttccgttttgctgacggtaaaagatttgatccgttccaagtgccgaagtcggcattttgcgaggtaattgaggtaccaatacatccctgcaagctcgtcgctctggtacacttccaactcgaagccgagttgaatgatccattccatttgtcgcaacttgtaaaagtaggcccatgatgacagagataaaggcaaggaatctgcgtattgagtagcattcaggaacatgtgtgataatggcgattcctttatctgtgcttgaacgacttgatcaacttcctctgcgtcgacttgaagattatcccaagcgcggacagtgtgacataatgtccttcgtacgcgacagcgattctgacacagagtacgcagtatgtctagaaaaggctgggcagccctctgacggaagaactccatctgttgagaaactataaaccgcggatcatgaacaacctcgatttcgtcattcaaacggtccaacagagggctcgcaggcaaggtgattatggagaggtcatcatcaatgagttggcgaatgctcatggaacccagtacctccatagcatcgaaaaggaatgtctggagcagcgttctcacatagaccaaaggttgcggttttttggactggaacgccgacacacatgtctatccgccaatgggtcagcaaacacatggagaaattccagggtttaacacttttcttgtttaacgtacctgcaggcattgtgtgtcagtataatggagaaccccgattatttcaaggccgtcttgaaagagtcgagtgaggttcccaaaggcatcatcgaatccaagttgaacgatgggcctcggtgggattgtgctcgccagctttctttgcaacttggcgctgaaagaatcatccacaggcttgcaaagatgatgtgtcgacttcagagccggaagaagggatatgccttgctgccaggggatttgtgctaagttaggctccttgatatattgaggacactcagtggcctgtaagaatatatctctgagctccaagcgcacctcaagggcatctattacttcagcccgataagaatggctagcgtcactccgaagcctttgtagaagacccttagcctcagttatggcagtccggattgcatcagtcgatacgtttgccaacagagtccgattataagtgttggtaacgaaatcctcctcctacgaacagttagatggatgaaagttcacaaactgggagataaacaactgaaaaaaaaagggcacaaccctacctcgtaagagtgttcagctctgacacgctcattaacatatccacaagctttgagcaaacccaagcagtacgctctcagaacttggagcatgggttggtcattcgctttatccttcgggtctctcacgaatattgcctgctcgatgccgacagggtttggcattgataaagcctctacatagacactggtaaagagtgtttgcgatagagggtaaccgaggtgccaagacatcttgtacggttagaagtctttgattagttgatgaaacagtaggggctcgcccggttacatacctcatggcatatcagttggtcaattataccaaggacctcttcaggtaaaagaggctgcccaacatcatagagctcctcaaaatcatcaccaggctgtatgcaaccgctgtccatcttgggatccatgatcttagatgattgagtgtctcattagccatatcctagggataaggacaaaagccccttcatgcacacacctctagagccccaacggactcgaaaagggtaaagaactcatctttgatgagctcaccgggttccaaagctgccagcctgtcagccactgctcgtccaagacggtcctgcaccgaacccaactttgccgaaagatgaaatgcgaggggggcaactcactcctaacggccagggaaaatctatcggtgatatcgacagtcacgatccctgcgctgttcatgtctggagctcgggattctggttgttctgccccgttgcccaacgagagtcgcgcaagttctgtgggtgtgtgttcaggtcagaaattttgtcctcatgatgatgatgcgcaaggtgctggatgataatgacccaccatcgggaacaccaatgccaaagtcggccatctgagtatctgaaggaaatgccaaggggtctttcctttttcgctccagtctcagaggcaagcatgcagaaaactggctggtttgcacctgcccgcgtttggtagtcagaggtaccttgcatgcaagtagggtataaataggtaggtgggtggtaaaagtgcacctgggtgcagccaggcatattggcgcctgcagaacggctgctcagcaagcaactaacctccgatcgctaagagtcatcgtccatgtatgtgcgagttgatcaatgactcaaaactccggtcaaactcccagttaaaatgaatcagacatgcatatatttaattagctcaagtagtagaacgcgtgcatccgataacaggtgcttgctgcagcatcctgcaaatttgtagtcatacaggtggatgggtccaggtcgcttggttgttagcatagccgtgatagcgcctgttgatgagctcttattcactgtgggaccgacgcggccaaacctacaacatcataatcaaacctacgggcacagagcaacgaattgccgtagagcaagatcgtggattttgttttggggtattgcgtttattgtacaataggcaacatgtgcaccttgctggcgtgtaggaactattgtacctcctttcttcccagcacacccagtccctcctcatacagagagacctgcgtcccttgatccatcatccatatctcgacccattcgcaattctatgagggattgaattgtttaggcggcgctctcggccatggcagcggtgttggccttctcgaggttctgggcctcaccggccttgccgttctgtttcgttgaggtaatttagcattcattctctccggaccacagcaacaagctgcacgggcgtgccattctcacctgccacttggaaaacttcaggtcggtctctccgcgtcgctcggcaatgattcgcttgtcctccttcaggctgcggcgagcagcgcgggccgcgatggccaggtagcggttgtagctattcatgcaaacattagctttccatttgtccgtttccaccgtggaattgagcaggaagcttcgagcagtcctgaatgatggaggtccaattgacgtacgtgaggccggcggctttccaaacagcagtcattttggcggattctggttcgtgatggaggtgggaggttggatttgttcggctagtcttgagattgaatctgcagaatggggctgctggattgccggctacttttcccgagcctgaggcactcagctccgggagtagccaagtcacgtgctccactacaccttcaccgaaaatatgagcattcgaattaaagctgtataacaattgaaacaacgatgtctcgcgaaggtaggtaattatcacgcagtcaacgtatccaaatgcaatgtcttcagcagttcggtaaatggctatcatacggatggaagttcgcttgaaatgcatttggtatactctataattctatgattgaaatcgtcttaacaaaaacaagaaccaaagaaaaggccaatatatcccataaccaaacaaagaaaatccccccaaagatggccgcacttactatctacggaccgccgctagcaccaccagcaatcatcatgctctggtgaagtcgtcttcggtccatctccttcttcagcatgcaaatgcagccggccaagatcagtgcctccatctgctcacgttcacccttcctgtccacgttccactcactcagatccatcatcaaccgcccaccattgccagcagtgctcctccctgagccggcagtcctgaattccttgttccgcaccagctgcgcaacccggcggtacctctcctcagtcttgccgcccgcaagggccacggtggtgacgcgatccattaccaccaggctatccgcatcaaactcgcgccgctcagccttgccagcgtagcgccagaggaatgtgcccaggtgtgtacggatggagacagcacgggttgttacgcctctactgagcacctcaaattcttcctctccggcggcaagctctcccttatcctcgcccagcgtgctaaagtcgatatcagagttgggcccgagaaggcggatcttcggtggtcgaccaggaccaaaacggtagatggttgtgcagacaggctcagcgcctgcagcagggtcgccacggaaaaggatgcagcttcctgaaccacgcgttggtcgaactgattggtataccttgttactcagtattcctgaatcaccaacagcgtacacctcgatcgggtaggggcgaggcggcagaggtaaggcaattacaggcaagcccttattctctacttggaggctcttggttggtttgaacgttgtgccagatgggccagtggatccggacccagcggctgaggaagaagtctcctcatagacaggcggagatgaagaggataacgaagatgttgcagaggccatgggcctcagttccactgtctccccatggaagtaaggtgggggagacggagcgccaacatcgaggtcgcctttgatgtgaaatgtctccgtctgaactgtggccatgatggatttcggtaaagtactaagatgatgcgatagacagctagatccggattgttgtttgattcttcggtaattaaagggctctcgactgtatggttgttctacattcatcaataaattctcaaaatatgtgccagtccttgagcctatatactttttcctcctcgctgtacccgttgaacatcttgaatattgtcccaggcacatattgatgagactatcgccatgtggatcaatgcgatgcacgctaaatcaaagaaacgcgaaatacggtgccggatctcctcaacgataacgcctacccacgatcttggggcaacgctaggcagccaagccacgttcatcccatggcgccaattggccagtggtgggtcggtagaggctatggcccggaatacgacgaacacgagaggggaaaccgatcaatccgcggtgctactggatcgccagagcgtcatgcttggcggtaggcgtcatgggtgcaaaatgcagtatgtatgtgtgctgtggtgggtggattagtctcggatgtcgctcatggcgagccttgataggtttctagacggcttcgctcggtcagccagcttgggtaaatgtggcatgtgacacgaggcatgtaagaccctcacacccagatgaagcgtagggcgccgtcagtcgccagccagcaaatgtgcggagatactaaaaggtactttaaaaacctaaggccgcctggcgtggcgcgggtcacgtattgatcgttccgaaggaacatttcttaagatcaatctagcccggcatgcaaattggccctccagaccagttcaccaaggacaagaatgacgtggtcagaagatgagagaaaatgtcgattcttagctaggtagaaataccggccccggccaccatcattcgtccgcagcaatttggctgtgacaactgactggcgtcatagcattcttctcggtagcctttcccttcgatttcccaacgccatgctgacacccgcccagtgttttaggtctctgcagaggggcccgagagccaaaaaggagcgtatgtaagtgaaataatcatctcagcttcccaaaaaatgaaagatctcgatccagttgcgcttccacccacatcggccattggttatacatctggtgttcatagtcgactcgtgcattcaggtaccgcaaccatcgaagcattccgggatcgatattgtgtccttcaccaggtgcgtgcttctctcgcacctcatattcttgctgtgtaataaatgtcatcacctcgcccaaagcaatccaatgtgtgtgtagaagtaaaatgacttggttgtcagggctgatgagctcctgaaagacgctgtgtggaagcatcatccaccaaccgtactgttgtccatgtgctttgtacgctacgcagtatgtcagtcaggtccacattgaaatagacagacaaggacgttgctagggcacttaccatcccaagaacttatgtagagcttctgtactatgtccatcaacttgtcgtaatactcaatctgtacctgctcaatgcacagtggtcgtagactgccgatcgcctcaagagcagaatccgcccaacccctctggatcaaggggaggccttccatcaagggttccaaaagcttttccttctgctcttcgtccattaaggtagtgaagataggtttgatacctctgaacatcatctgcatccccacaatcaagataccgcggataaaggtcataaactctgccaatccatcatccaagctaactgattggaatgtaagagcaaaacaggtggcgatcatagcattggtctcctcagcagaagagatagatctcgcggcatcagcaaggcgcttcttgatggctttgatggccttgactcgatggttcacggcggctgttaagaggctgctatctgtcgattgaagctctgatgctgcaaagccgagaatagcatgcataagatattcgtgctacgggatgtcttgtcagcagagaaaccaaacagggtatagaagttatggtttggtatatgccgtacattatgagcgatgcagggtacttcgtgtgtccaaacttcttcctgcttcaatgggtgatgtgggtaacattgggtgagaaagtgctggaagaggcgcatatcttgcagactgaatatggggatctggttgtgaggctacgcgagacgattagcaaatggaacaccatgaactaatacgaaaagtcacttacttgatgggtgatttgagggagagagggatattcgcatttcaatcctgtcttgacgcaatgcccacacgctggttgtgtctcttggcactattccgcctggctgtcagtcatgttgttggtcaccgggaggtttgtcggatggaacgtaccttgatgcgcctcctcttgcagttgtaacatcccctgcgactcttcgtgtgtcccctccgctccagtctcggcttgggcgcagtctttcgagcaacctcagagttcacgcaatcagagctcggtgtggttgctttttcgccggcggaggagtctgagaagttgcatggtggagggggcgggactatgccaagctgcaattgtggtgagagaatctgccccgaaggtggttgaaagtaaagctcgtcttccggcggaaagggataagggtcgaagtccggtgcgctgtagcccagcaatgagggcgacagctgatggttcatgtccatggcgaggtaagtccccatctaggtggtgtgtgggatgaagtgaggatgaatgaagggtacgtcgatgggaggagaagcaagatacgtcagttgctcctcatgcgctcaacgtctaatatggtgaggggcttgggcggaaaagtgttttggtctcggatgtttatctttacgattgtctccaggcttagtctacaaccaagcgcgggtgtgtacgggggcctagatatatattgaaatgccctggacgtggataacgaaaacggacggttccatggaggcagggaagatgtaacgcaggcctggcttcgtctgtccgtccgtctggccaaagggggaggggtgaggaggggtgtggtgtggatgacgcgggacaaatcaacccgccgtttatggcaaaatgaacgcagaaagaaacaggtaattaatcgatcttttcgacagttgcctgggcgagggggagctaagtcatcacgtgtgtgacacccggcagaagcaaagatagtggcaggtagaaaaggcgactttccacggagatgcagccctatgctacgcgtgcgttcaaacataccaggcaggtacctcccatcacccaaaccacccaccctcctgccgtccataatttccagaatttaattaacgcctagccgatccctttcagctccaaggcagtgggtggcagtgagacggggcaagagctgcacggttgggtcagaaggctcagccgcagcccaccgccagatgcaagtgcacatgtcacacgttgcgtcgcggtcttatgccgtgtagggggggaggccttcttcccgctcccgacagccctgcaacactaaatctgcctcgactgaaaagaacaattgatgagcccgctctcttctcgactcccttccgacatacggttacatttgccaggactctccgtgcagggcagggtagttgctacagctctcgttctacgatgtggaaggattcagcacgctcgctccacaaaagcccccagccaaaacccctaaaaccccttcggttgcttccacgactggatctcagcaattcatctgggggtcccaataggacatttggatggcgcagcgaacagagttggccggtagggcaattaagcacaaggggttaattagcgggccacgtccgtcgccagtgattagcggcaccggggccactacagcggttgggcgggacacagaaacccgcccagccactggagcatagaacttatgtattcagtccgtcgatggatcccccaacagtaggtgggcatctacaggatatcttccattcaatgattaaccctcgggcgacagcgcactgccctcctgccgtaggtaataggtagacatgcttatcttgtctccgtgcacacaatggaatcatcgataggcggtatgccaacgcccacgcgctgacgaattctacggagcaggcaacctcaatgaattggatacgggagtgaggtaccagtacctaagctgctaaggtactagtatcaaagtcaatccctacactggacggtaagtcgtgcctaaggttacatgccggtaggagctgcggcgaatcagcatccggtgcactctctgccagcccggcaaaggttctagggcgggtgtaagtcacaacacgaccaaacacgacgagcagtctacacactgcacagcccccaactatccgttcaagaggtagcattgcgagccagccatgtgcttggaaattgggttttctatattaaacattttttctccatcggacacccgtcccgtagtcttatcaatgagggtatttgtgctaagcattcaaggtatccgggggggggtaatcatcaatagggctgagctgagtacctagcaatatgaacctcacgcctcgtttttttggtactcgcccgtttcatcatagtagtatccttgtctcgagtcgaccgttatggtcagccgttatggtacaaaccgtttgactcatacctttccaccaccacatggttcgggttgttgcatagcccagacatcaaatgcatgctctcaatcctcctcaccgcactccatcattaatgcgaaagaagtggtgggatatatccaagtataagcccccaaaatggtggggtcaatcctccttcggtatacttgccggacataaatactatgttctgcttcacccctgcagccgggagcccgtcccatcaagtccaaacgaggccatgcctcgtgggcatctgcaggcgagtatctagggcgaggctgagtcccggcggccggggtacctttcccgggggaataccctgctcagttcagatgaaaggactgtttatggaaatatcaaatacaagtctcgatttgcagccagtagtgccaccagccttgatctcacgaacgggaagttatttcctcggcacccaaaaatagagtattgaaatagggaaaggcctcgggctatgctgatggccacatttcgtctcttgccgcagttattgaaacagggcagaggctatggctgcgtcttacagatgtaagtatccatctaatcgcccaaaatccaacaatgatattggcttggtacgttgagagcatgagtctttgggccaccgtcggtggtcaatatcccatgaacttcgtatagttcgtttgttcacttgtaacagcattcaccgtattactatcacagacctagaagaatcatctgtctagtaaaatcttagccgattctacacagattgcttaatgtgcatgggcgcttaattgcggctcatgcccgccgtctgcatgagtttggatgtttcgccgtccgcaatacgtgtatctctttcacgcaaagctaccgcggtatgtagtatacagattaggcgaggagtgcgcacaacctcgcggcccccaagaacaggcatggatgcgatgcgcagttgcttgcatatgctttttcgtacatctcgctttcagcaatatagcaaccagtcatctaggaggcatgcatgcgcatgccaatgattcacaatatgactttgaaggggggggggggcactaagtacctcacttctctcttaccaacctcgtcccctactaatacccatccttctctgccagggtgaggagggctaggctgattcgtactgaggacgtacactattcattggtgcatgtttctggaataattttataatggtgggtatgtttcaggtttgcttcgatccatcgagaccagagatgttgtacttggataacttgcaagattaacccaaggcaagggcggcagaacagataatcagtctcggggtgtagcactaactgattgtgagaggttttacatctaacttgagtctctatcgtctgaagttaaggatttcaaaggatctccctactctaacttacatcgggataatcaggatctagagtcagacgtttcaccaagtttactctcaactcgacctaccgagatcaaggtagcaaaaaagcaaggattacgtatatgcatgcttcgtcccgagatttacttacaaagcctgtggcaaacggtaatacatatttgaaatcattaatctgaattcggataaagggtggcaagtactgaggaactgccttgccatcccccacagcaccgtagcgccagatgcaggaacgcataggaacatgcgttcctaaaggatgatgattccctgctttattgagacatttctgtcaaatcgcttttgaatatgaccttctagttggtgaagaacagctaggtggaatcgggaaatcaattgacattgatatttgccttattctcattcaacggctgtgcagtgccttaacggctgtgcagtgcctaggtagcctatgtatcctgaaattcagatcatcaacgctctcaaaaccacccagaacataaacatccataacagacaggcgtggcaatcaaatatggtagggggtatagtggcgtcccgagaatcaaatgacccgcgcttttcgttacaaccatcaaagctgccttccccagtttttttatactaaatttcacaaataattgacatttatcgccgatttatcgagtgcttcagtcctattcgtatatggttgaattgggtggttgatctacctccttatccaataatatgtcgaagtagtttgagactcatccagtacgaagcttttagtgctggtcggtatggcactccaccgactcgttaggagcggtcctctcctctgcagtatcataacctgtcagtctctatgagttattggtctatattttgcttcactgcacacgaagaagagaccaagagtcatatatatggtgagatgtagtttctttatagaccatagccaccacatctgaacgggtagagccatctgctttccagagagcgtcggcaacttggagaatgccagcgtttagcaaacgctagccagatgccagccgtcgtcgacaagtctatcatccgtgatttgcaccacaactgattccacaggcgaagatgcagaaaatcgcggttggccagtgactcttcgcacgaacacattggtgggaaagcgtcccccaatcaatatggagaattacgtgctacatcacgcaatgatatctcaataggtctagcaagaacctatcgagccgtagttaccgatcatgtgtaacgtgtgttactttgaaaatagctcgtcgcaccctgtaacgtggataattgatctagcaaggctcgctccaagataagcatcttctcgttccccaatttccattgatggatgtactgctttgatatttgatcgtttaaataatcacaatttgtccgtcttctatagtaaatagaagctcagctttggattgtacataaaacacatagtaagagtcaagaagcttagatgttttccccagctgaagttactctcgcctgtgtcgccgccaatgaacaactcagaaccttttcaaatggcagggataactgtcgtttattgaggacgtagaaagaaatccaaccacttcataattagaaaaatagccccaagcaaaggtcattacaagctattaatggtagaggcaggcaatgacatttggatacctgcgatgtcgcaccgaagaatacatcaaaggtctaactctcggcttggcggcgccacggtaaacgcaatgtgcaatagcatggaaactttcggcccctagatcaggaacccgggttattgagaatggcctagtttcaaagggcggcaagcagaggcgggtgcttctagcgactacggatgaacccttgtgctgtgatatctaggatcgcacaatgtaaagttctgcgaatttcaatgaaaattattttcagattgaacttctgtgcccatgattccggttctgataaatcaaagaaacggttgtctcgaaggtcagttaggttaagatgagtgttacagccaatgcgtcagaggccaccaggcggagcaacggatgagttgacaggacccccacagcgcacagcggccaaccgaggaagggatgattcatcgctgataagctaccgagcatgggaggtagcacggcgctccaatccgtttagtcccaaccccggaccagaggtggcgacgaggacctggggtaacggagtgacaagttacgatcgggaacaaccgtagacatgtggtgatgcttgcgacccttctgagcgaagtagaaaatattaaggcgaaagaacccgaatttctgtcaaaatggaaaactggccgcatctcctacgacgtcctctcatatatagtcacaaaaggatcgttgctggcgtatctaatgtctggtagctgtgtgtgtagggtatcttcccagtatgacatgaaccagcagatcggagcgatacaggacgccggccgccgcgttgtggggatttcgctggtcaatggcattttctgaaggaccaatggggtcgacggttctcccaacgatgctcggtgacgatggcaagatgtacaatgctatccatagttgttgcaacaggagatgctgcgtctgtcttcagtggctcgagatgcacaaccctggccagaaacggggcagattgcgggggaagcgtggatacgcagactgccgggacactcggggacgtcggggttggggaggacctggttttcttccattatgtaccctctttaaatagcagttcgtcctaccagtgggcgagtagttcaagccgaagctttccacatctgccgactgactctctggaagcacagccctaataccaagcacctgtgaatcatccccggctcctgaaccgattgtcccgtattgggcggacggatctctagttagatcgtaggcaatttgtaggagttggggtcttgagagacgaagggtccaacagaatgggggcttttggtgcaatgtggaaccagttatccctgtaggaggtcccttgctgctctccgtcatccttgtcgtgggacgatgaatcattttggaaatttcctgtacgtgcagtctgccatggagaaacacggcgagtttccccaggtgccaacaagcaatcctggaaacagcaagccgtgaccaatggaagtcccggagctaagcatttattgaactgggatgcgcaggtggtcattcgtgatccttccctctgctcccttccacatggaaaccccaacaatcgcaaggtcgttttcgggctattgtcaagatcctgtgcggcttcatgtccgttcctaggggtgagcagtctagacaggaaggcatcgacctattccaggcctccccaaaactgatgccaaaggacaacagcagcagaggcgcatcgtgtgttttccagggcgataaatatcttcgcagtacgtaataagctaccataaacgctccataaaacggggaccgatttcgcagaagactcttttataaattagacgtgccaggcctgcctccatgcatgcgccatgcttctcattgggtagaggcatgtagcatcagatttgttgagccccgaagccctccgtgatgcaggccggtggcagacatctaactggatgtttgaagatccagattgcccccagccactacgtactcatctggggagcaagcctggccggactgaagggacagccgagggaaccaatgctgggccagcaattgagcatcatgacctaccccaaaggcgggaggatcagaggctttgggttagcccggaacgtaatgccgagtgtgatcatcatggctctacgtatctcagtcaaaagatgtcagcgtatgaggttatcaatccaggctgtcgctcggccgacaggagggcggccgggctagcaaccgagtctcagaataggctgtcacgcaggctaatgcgtggtgggcgatgggatgtggtaaggggggttcttgagagccgatgggtttgccggtggcagagagacaagatcaagttgctgctcggggcaaaggagccaatggtgggactgggttcagcaagacaccgtcgctgcggctgccagagcccagggagctccctcccaaaggcagcatgcagctttaccaccggccctggaggctgcagtgagctcgccccgccatctttcccagtacagcgggcagctgcgtgcagcgtccaatgagtgctggcaaggtggaatgttggggatagccgggatggtgtccaccagcacctagaggcgacctactgagtagccgaccacacccactcccacgccacgttcctacgcctggacctgcggtggcagaggcacgagtcgcgataccggccggccgtctgaaatggctgcttcaccagggatggacaactcccgttatccatggatcctttctgcctacctaggtacccattactcgacaccattaatcatacgcctccgcagccgtgagagagctccttctcctgtaccccggcccgtcgcaatttcaacataaaagtatcgcgtgccccctcgcctttctgcgcccctccactagtctcgcctgccaatttctcttcctcctcctcatctctcccacctgctctctcttgtccccttcaactcgagggcttttcttgcatcatcttcgtccattgctcagtgaccagcgagttcctgtgatctttatgcgactttggcccctgtactggagaacctagaacggaccccgcatcgacccctccagcagaatcgaagtactggtggtagcaccatcgcgagatcacccccacgataccaccttgaccgcctactacctcattcctcagaccgagatatagtgttatcagccactcgttgggaacagtacaacgagatacgacagagagttatcgagaacccaagcccagccgatttcaattgcacaaagtcacaatggctgaagccgttgctgatcaaccggccaaggtcgtgtccgaggctcatggcgtcgacactttccgtaagaaccaatttcccattgccgaattggcaaccaggattgcgcgtactaacccttttatagaccctccccagaagatgtttgaaagtatgcttttggctactcccctcccaaattgacttgaagttgaactgtttttgttggctaaccgacgctttcattctatcagagcatcccagcaagccccacatttcaagtaagtactaggaagacatccgcattaccgacgctgtgattggtcaatgtcccacgctcctcgagatgcccgactcttgagcgcacttctctcggtcgcattgttcaccgtgctaacaagtctccgtcgctagatttagaagagtaccgacaactgtacaaagagtccatcacaaagccacaccagttctggggccgcaaagctcgcgagcttctcagctggtcccgcgacttccagaccgtccacagcggctcgttcgaacacggagacaacgcttggtttgtcgagggccagctgaatgcttcctacaactgcgtcgacagacacgcccacgcagaccctaaccgagtcgccatcatctacgaagccgacgaccccgccgatggccgcaacgtcacatatggcgagctcctgcgggaagtgtccaggaccgcctgggtcctcaagcagatgggtgtccgaaagggcgataccgttgccatttacctgcccatgattcccgaggccatcattgccatcctcgcttgctcccgaatcggtgctatccactcagtcatcttcgccggtttctcatccgactccctgcgcgaccgtgtgaccgatgctggatccaaggttgttatcaccacggatgagggcaagcgtggtggtaagttgattggaaccaagaagatcgtcgacgatgccttgaagcagtgccccgatgtatcccatgttttggtgtacaagcgcactggttctgagatcccctggactgagggccgtgactactggtggcacgaggaggttgagaagtggcctgcctacatctcccccgagcccgtcaactccgaggacccccttttccttctctatacatctggctcgactggcaagcctaagggtgttttgcactctaccggtggatacctgcttggatgtgccatgaccggaaagtacgtcttcgatatccaccctggcgatcgctacttctgtggtggtgatgttggttggattaccggccactcttatgtcgtgtacgcccctcttcttttgggtgttaccacagtcgtcttcgaaggcacgcccgcctaccccaacttctcgagatactgggatatcattgagaagcacaaagtcacacagttctacgtcgcccccaccgccctgagactgctcaagcgcgctggtgatgagcacgtcaaggcacagatgaaggacctccgtgttcttggctccgtcggtgagcccattgcagctgagatctggaagtggtacttcgaggttgtcggtcacgaggaggcccacgttgttgatgtaagttcaagaagatccatgtctacctgggttattccagtgctaacttcagttgaaagacctactggcaaacagagaccggatctaacgtcatctgccctctgggtggtgtcacacctactaagcctggtagcgcttctctacctttctttggtattgagcccgccatcatcgaccctgtttccggagaggagatccacggcaacgatgttgagggcgttctcgcattcaagcagccatggcctagcatggcccgcactgtgtatggtgcccacaagcgatatatggatacctacctgaatgtgtacaagggctactacgtgagttatatatcgcaccttggtggataattgaggactttgactaatgcatatctttcagtttaccggtgacggtgctggcagggatcacgaaggcttttactggatccgcggacgtgttgacgatgttgttaacgtcagtggtcaccgtctgtctaccgctgagatcgaggctgccctgattgagcatcactctgtcgccgaggcggctgtggttggtgttgctgatgagctcaccggccaggctgtcaacgcctttgttgctgtcaaggcaggacaggaggccaatgatgcgctgcgaaaggagctcatcatgcaggtccgccgaagcattggtccctttgcggcccccaaggccgtttacatcgttcccgatatgcccaagactcgtagtggcaagattatgcgccgtgttctgaggaagatcctcgccggcgaggaggaccaattgggagatatcacaacggtatgttcgcctgtttcactcatttccctatgattgcgcatttgactaactgaaatatctacacagctgtctgatcctacgatcgtggaacgcatcattgctagcgttcacgctgcgaagaagaactaaggcgcaggccacaataagaaaaaaaaggaaaaacaaagaaaaaaaaccataattaccaaagctttcccattgcataatgatggccatataacgattgccccagcgattgtttgatagttaactcttgtatatattcccgatagtgatggcgaaatgaggagcttggctatataggttggatatttaaccactacctagattattctcaatatcaggcgaatgtaaatatgtcttgaattgctcatattttggtctcgttcgcctttcgctgcctgacttgtatcatgatgcaggttcaaatgcctatacgggttttaaggaagctctataggagctactaagcattcattccccaggacgtgatatttccggtagcaaacatcagacagaacacatcatactactgagaaacacaaacatggatcaatttcccgtgatcttatttgcatcattctgaaccgttcccggcgcttgcgcaaatctgcagtcgcccatcatggatgatgatcgacttgaccaccccggttcgccgccctcaacctgtctgctgcacaaaggccaccaacccatacagctgctcgacgtaaaaactgtatttgtgttagcgattctgacagaatcgcctgcgaataatacctagggtcatgaccgcgcagcaatggtctcactcaataaaaagccacaggcttgcagcattattccttttatagccccataccatactcactcaaacaccgatttgacgatacttaggtctcccttcctgttcctgtcgtcgccttcatctctgccacgaccagctgtccacaaatattgttaatccaatgggccatatcgtaatggcgggacgaattctgcatgaactctgttcttgacgtgactggggactttggtcatcgattctaccccctccaagaggactacttgctgccccgcctgtctcttcgtcagtcgctgttttcccttggctcctcatcaagattttgagaaccacttaccccaaagtgatgaatcatgtggcaatgcaacatgctgacagcaggaaaggcaatctcgtagcggataaccgtccagtctccggtgtgatttccaagcctagccccatctcggatcggaggatcctcgaggttgaagttcttcgcggcacctccttcgatggcgtctgcgactgtcgcccaaggaaagccaccatgacctgccccgataatccaggctttgttgttgtgcttgtggaatggatgctgtgatgtgacgtttgccccattctcgtagacgatgtccacaactgacccgttccggagctgattcttgccataggtcgtcccgcctcgggatgattcatcccacaacagcggcggcagttgctggcgaaatgcttggtgagagccaacgcccagagcccaagcaccaggccccgtcatattaaccaagaacttgatcgtgttgtccgactttgctgggggtggtcgacgcgggtacgggacaagcttcatctcatccatgaccttcagggagggcgagaccagcgacccattaagatacacccatggcttcgtgatgggaatgctgggggcagacaccttattctgggtcgggtaacgaagaatgccgaggccctggatgatttgttccatccggagcgatgttattctgattgcatagtcgtccggtttccggttcaggtgaactagaatgctgtcatctaatcagtcttcaggtgccatggcatggatatacgaactgcgcgtaacgaaattgtggactgacttacctgatgcgttctcccaagttgcagttggcagcatgtactttctgaggatgcacaaactcgccgtccgcagcaacaacgtacatctcgtgctcatcgatgctaatctgcagttcgtggtgcgctcccgagtggatgaagttgatccaaatccactcttctccatcctcggccgcgataacttcaagctgcccctctgttggctcgcagatctgttcgttggtgtacatgctctgcctgggctgtagcaaacagccaaggccatttcttccagcaccgcctacctcctccaagagctccttggtgtggcaatatgtcctgcccttgccattcagcacgatggaattgctgcaccatggcacaatgcccgtgtcgcgatacatgatgagcaggatgtccatgggctcggcgttccaatcactgatgacgacatgcctaggattttcctcggcgcgcttcatgcgcaagacgtctcccggcgaaggcgacacgagtgaatagggccgtggcctccacgacgccggagaaatccatatgggacccctctggccatcggcaaaggcggggccaaagtgcccgtgatagaagtagctgccgtattgctgctgtacggtgaagcgatacgtgcagttgtcacgaggctggattgagtattgagtcacacccggaactccgtcattccaaggcctatcaacctgataaacaccgtgcctaggtagccaccgagtcagcagcaaaatatatattgtgatgggacactcatcagacgcaccagtgcatggtcgtttctgtggcgagctgattgtcgacaaacacctcgatctcctcaccctcttccgcctcgatcagagggcccgggctttggccattcatgaggaaaatcggacggccatgaccatctgcagcgcgccatgcgttagtgattgtcaagttgtactttctcacagccgccgccgcatccacaagccacaatatcaagccaatattcaaaacagagagacgcatggcgatgaaatacgatccttgagataactgccgaagggttgttgtgaaacgttgcttgtttccccagagctttgacgtccaccggtacaagaaacggggttagagggccaatttaatagtgagcgctccagctcctggactgttgaaatgtgcgttcccggggtctagaccaaccggttgaatacagatctcaggtacatcaatttaggtgaaagaaggctgatactacttgtaccagcaatctccctgtatacagagggttacaactaataaagtatacgagctgggcgcgggccctctagcctgacatgaggtattgcaggctctcaatcttggtcgatcgtgaggtgcttctattacagtaagtatcgacgtctaacgcgtatgtatgtcatcaaggaggtgtggataggggcgtagggcggcccggagcatttccaacggtccaggaggatgaaaggggctgtcaagctgtgtagatcagttaccctcatcccatcatttgcgagttgccaggcaagtgggtgacataacagatcgacattaaaaagaagatcttattgtatggggagggggcgttctcggatatgctctgggttaggaagtctagcgctgatgtctgtcactactggtgggcctgttaaaagggtcaaattcctgggcagggtgttaatttatggtagatgttataatcagataggagtttaatttgagatgtctctgcgtttagatgtctctgagtttagatatctctgaatttgggtatctctgagttaagatatctctgagtttagatgtctctgagtttagaaatctctgagtttagatgtctctgagtttagaaatctctgagtttacagctaagtcagagttagagctactgctcgccataacaagagacagctaggtaggcagcttcatcataatacctattagcaggagataacagcgtcttgatattgtgtctagtatgggcgtacccatcagttagcattgacacctgttacaagcctctaacatatgtccagtcgtaaaaaacatatcctacgccatgccatgtccagaaacagccccctccctgtacggtaaaattcggtgcctcatctgttatgtcaccaacttgctgggctgtctgtcgctaggtaacctctacgaggcgacatcgtcgatttcgccgggccagcttaggcatagattgtcgcatccccacgggggaaaacttgacaaacgtgtcgagtatatatcttttgtccttcgacgactccgggatagggcgtataatctcagcaacttgttctcttcgaggatctcaagtgtcatcaggcaatggaaaaacaagctaactatgctaccgacagcaggctcggcctgttctcgacagcaaggcgccactgccaccttccaaagaaaacttggatgccgtctattgtttccctggtcgtttttgttgcgctctgcctcgggtacctacgattttcgcatccgctcttcctctccgcttgggaggatgatgacccaggacggctggtccgtctgacccgatcttacagtcttgagacgggtgtccgatggatgaatccaggtcagcgaccgcttcagctagactccagccatatacgggctaacaccatagctacctagatggcggccggtggagagtaatgtttgtctgcaatggtcagagcccatgcccaacattgtacgccgaagagggagatgtcattgaaatatcggttcgaagcgacatttatgcacagtcgtccattcacttgtaagaacgggtactgctacatactatttctcctttggcatgctaaaataagggctgtatctaggtccgggtttggacaccccaagtaagttgggcagcagttcctgatgaatttttttttccctggctcttcctcttcgttactaatgagaccttgactaggactggcccctggaacgatggcacggctggcatgtcgcaggttagtgatcctatcgatatatctttgaccgaaggtattccgggcatcgcatctgacactgctgaacgcagttccctacgttaccaaggggtaactggacaactgcatatgatactaccggaaactggggcctgaactggtacgccgagcacacctcatcggcctcagtagatgtaggtatcctaccgggtggggtttggggtcaaacggcgttgataacattttctatagggactctatggtctcgtctatattgcgcccagcccatcacggccgcggccctaccatttgatcacgaatgaccgcctcgaactgcgacagattgaagaggccgagcgcacgatccatcatgcggtgatccagaaccaccagcatcgcgataccgtttggaagctgcttcgcatgagagcggaggggtccgagtactactgctatgattcaatcctagtcaacggtgagcacagcatatctagactcgtgtgcacctattagtatgagctaataaacacattccgtgagataggcaaaggtcgcgttcactgtcgccagcccaacttcgaatacctcaatgggaaagctcttgatggtaaaggatgtatacagccaccaggtctgccagacgagtcttgttcgcctaccaatgcggactatgaggtatattgaaaagacaacgttgtgggtgacttacgtattgacttccacattttaggtcttcaagacaggcggtcagggctacatgatgatgaacctgctgaacaacggcttcgagcactcggtcaaagtatccattgatggccataggataattgtcgttgccaacaacggcgggttcgtcgttcctgatcataccgacgtacgggaaactatatgtagactctgggacagccgatgctaatgtggccatgacaggtcgtctacataccgagtgccagtcgaattactgtcctggtgaaactcgatgctgaaccgggcgattatgccatccgaatctcgtcaaccagtcagctgcaaaaccttcagggttactcgattttgagatatccggtgcgttcagttggggcccatacgtaacaaaggctgatgtgttcatataaaaaggccaagcgtttgccccgatatggagagcccatggaactccctgtacctgcgtcgcccaaggacgtgtgtctcctcgctgatgcctctacgaaggctcactgcaagacaattgagggccagtttcttcctccttatcctccccggccgcctcctatcgttagcgagagccacccagggcgtgttgactttacttttcgcctgtcagctggttcccagccgtccaaaacagagcccaaggtgcccgagtattacctgaacgaaaagccctggcagctattccgtggagccatgacccctctcctcttccatcaacttgattccaatgggactttggataagcctatcattagccaattgccagttggatctgtagttgatctcatcatagagaacgagatcaacgacaccatcccgctgtacaagcatggagacccggcctggcttctcggttccggttccggacagcattttcctggagaaacagtagaagaagcgatccgtgctccggataatgctcatggatctctcggcctggagaatccagcgctcgctattgtgcatgatttgccacctcttggatggagtgtcctccgattccaggtcacgtccaaagctgcaaacctgttgcacacggtgaaaatcagatacttcttggtacttcgcgtttcccgcacatctctctgcttctgatttgctgacgctctgtatagctcggtatgacagtccccatcctagaaggtataacgaccaaagacccgatcatagttcccgaggcagctcaggaccggccgcatattgagtttgaaccaaagaatgacggaatttttggatgatcgtctaacaatctgaggtttactctgggttgagggaatgggaggaaacggttatagagggtcagtggaaggagatggatttgcgatcttcttggaagtgtgcatttcgtccgagtttccgcacctcgatctagccatcagaactagaatagccgctcttgtgaatcgatgggaagacagtggatttaacaaccccaaaaatgattcttccgctgtctgcaaatttctgtgaggagctagtgagtccttgactaacgagtagagcttatgttggattcgatctggtcaattcgatcacggtgataatgttgaatacgtacgatactgagccccaaaggattatcggttttttttctccctccctccctccctctctttctctattgttcttgatggatctgcctggcctctaccccttaccttttccccgagaggggttttgatttcagtatgtaatgacttgagatcgctatcgagctgactgatgtccctcgttataaggctccacaggaggtcttcaaggaggggttcaatctcgctgtcacccgcgggtggattcgtaagtccactgcacgacatatttacgacgatggaagtccaagaacgacctagaaaacggattctattccatgtctaatcataaggaggaagacagatggaagaccgccttcttgcgcaaactgggttgttgattcaaagggcttgaccttgacacatttgaggactcctggcagggttgaacacgatgagatgagacagataataatctaaatctcctgggcggcaggggtctccgtacatgcagggcaaggatctgggcgatccgaaaattgctaaccagcgcggccgagagacagacggaaggacgaggatcagctcatgcttggtaggtgggagctgaagaatgcccaggttgcacctgacgcaggttctttcgtatcgcgggggaggatttcccgcatccctctgtgacactcgcattgagctatggcggctcaatgctgtttcaaccatgggtgcggcttaactgggtccaatagctgaggaagagccggcatcgtgataactgggaccaatccagccaagagccagctagccatggcccgggagaccaacagcggcttggcttgcagcgccgagaggacgagcaatttgccggaatattgggggctgtgagaataggtgcgtgcacagcgtctgtggctcccacggtgtcccaggcaggtgggtgcggcgtttgtaagcgtgttttcagatcagctttcctgacagaacccgagcaagatgcaccgagaagtcatcttttcccatggttcgtggtgcagggatgacggtgattctgactgttcacgtgttgggggtgctaagaatagaggcagtgcggcgcaaggaaccagcagttagttggtgcacagcgctgcactggcctgcaaccgccctgctaagaataggatggccgctgccgtccctgccctggcctccatctgagggggatcgctagagcctaaaactggcctctcagtggcctacgggacgtccccgctgcccgtcaagggactttgctggtggggggaattgttcaatttgtcaatgtctgaaccacccacatttttttacgcccagccttgattatccaaccactttgttgatgctgacgagtcctgtccacattcgctacgccgctccggattttggctcagcgctgccccgttctgatcgtctctcgctcgtttggttggtgtcagccggtcagccctgcccatacgccagtgtattcatactatcctgtttcctcccgtctagctcgctcgttcactctctactcccgcctacctaatatcttaggacgaccacaccgaccattcctcgtgagcgagccacacccactgcgatccctctcaaccgccgcaccctcctcaccggtctctgtcggttcggttccatcaccagaggcctcagccgctcgttttctggctggctacctgattgaagatttatatatatatatacattttgcccggcctatagtcccccctccagcgtgtttatttcgccccgttccctgtggaggtcttctgccgcatggcttggagttgctagcgtcattctcttgatagtcccatttttgggttcgctcctcgttcctttcgacgatgattgcccttcggcccattgcagttgctatcgcgggtgccgcgttagtgttccaaacggctctaggtaggtttcccgtcgctcacaagagggaaacaatctggttcaacgactgaccggccgctgcctccgcttaaccaggccactctctccagcgtaatcccgtcagctatgtctcgctcgtagacgagcccgtcatcggcactccgtcgcacaaggtccactcccgatcgagcttcgacctgacttttacccttcacaacggcgaccagccgatccggtttgtcctggagccgaactacgacctcctccacgatgagttcgccatcacatatgtcggaagcgacggcgagacccggacgaccgagcccatccccgcagagtcccatcgtatatacaaggggcgtgcgtttgtacatcgccatggacgttcgggctggtcgcatgctggatgggcgcgtatcacggtccgccaggatgggctgaagcctgttttcgagggcgctttcagaatcgacggcgacagccaccacatccacacggtttcaaactatcgcaaggtgaagcaccaggacgatccggaagtcactgtttccgaggagagcggggagaggatggtggtattccgagactccgatgttattcctgattccgacatggaactcaagaagcgcggattggagacggtgtccagctgcggtgccgatacattggaattcaacagccagtacgatgccaacctgcgaaagagatctctggcatccatcagcgccgcgtccctctttggccgccagacggtcgatactggcgatgacgctggtgccaactactactcgactattggacagaccaagggctgccctacaacgaggaaggttgccctggtcggaatcgcgactgattgcaactactggtcggcattcgacaaggacaaggataaggtgcaggagcatgttatcagcatggtcaacaccgcatcccagctttacgaagacaccttcaacatttctctgggtatcaagaacctgaccatgatcgatcaggagtgcgcttcgactgcctccgaccagtccccctggaacttgggctgcagcgacggcgacctcagcaagcgattgaacctcttctctgattggcgcggccgatatgccgacaagaatgcttactggacgctcctcaccacttgcgccacccagtcggccgttggccttgcctggagaggccagctttgccgtgagggctcgtcccaggccaagggaagcactggaggcaacgaaactatcgccgcgaccaacgttgtggtgaagacatcagcggaatggcaagtgtttgcacacgaaactggccatacgttcggtgccgttcatgactgcgctagctcgacttgccccgtcagcactaccacacaatcatgctgtccattcagctcgagcacctgtgacgccggcggcaagtatatcatgaacccgtcaacggagtcgggtatcaccaacttctctccttgcagtattggtaacatttgctctggacttctgggtaccgttgacgatgagtgtctgtcagacaataaagacattggtacttttacgggcagccagtgtggaaacggaatcgtcgagagtggtgaggactgcgactgcggtggcgagaagggatgcacaaacaactcgtgctgtgatgcaaccacctgcaagtacaagaccaatgccgtctgcgacccagacaacgagagatgctgcacatcctcgtgccagttcctatccaagggcaccgtctgtcgcgagagcactggccaatgcgaccctgaggagacttgccccggtgatgcgggtgactgcccaactgatagccacctgaaagatggtgatggatgcggcaatgggttgcattgcgcatcgggccagtgcacctctcgtaccgagcaatgccgcactacccttgctagcagcaagattagcaattcctctatccagagctgtgcgtatgatgtttgccgcatatcctgtacaactggaggagatacttgctccatctacaacacaaacttcctcgacggcaccgactgcgccggcaagggtaagtgcaagaccggagtctgcgagggctcgagcacctggggcaggatccaagagtggttcgaggaccacaagaacattgccatcccggtgggcagtgtcattggtgctctcctcctgcttgccatcgtcagctgcatctggagcagctgcaagcgccgcaggatgcggaacggcgcagccaagcgtgcggcgatgagcggcgccaacggtgcagcacctttcacacgcgggggtcacccatcccgtccccctggatatggaagctatgagccggtgccgcccattgaggagaggacgtggaaccgcactcacagctcaagatatgcttgatacatacctgcatagcaagagctttcttagcacctgatcatagatcatcgaatattgattctgtttttattttctctttttgcttagaactgagcaggtctttatgcggttgttgcatcatttctgctggcgtttttgggttgatcttttcccgccttttatggttgatgatactatacttctcctcgtctatttctgatgattattgttattggcatttgcatagatggattgattcaaagaagcacactgggttcgaacaagcttgggtgtgggtggctggatgcccaatatttcggagcttgattgatattctgtaccttgacattttctgcccccccctttttggattatacgtttgtaactggggaaaaaaacctgcctcatcggcaggcgcaaataagaaacttgttagacatttaacatagcttttttgttcaattggtgattttgttgttcattagatcattaataatcgtgcctcatactcgtttcatagtccctcacttgtaagaaacaaacgccagttccgcctccactcgcagagttgcccagctctcaatcatccggctgctcttcatccgctcgagggtcccgcaatggtgaaaccgccgctgccgctcacgatccgctgtcccagctccggacccttcagcggggtggacgggttgctcttcgagccgatctccgggggcatgttgaggcccgggttcatcctctcggggctcaggcctgcggccatctgcatgaagcgcagccgctggctgggaatggactatggggcgagcacggaaatcccaagcgttagcccccctccccccaagagctgggagttgcgtcaaaaagaaacaaagggagagaaaagcaagaggggctgggagtgtaggttggcgatgagaagggttcaaacgtacatcattctcgctctgggcatacatcatcagcttctccggagagtccagcaccgacatggcataggccctgcgctctctagcctcgtacgtatccttgggaaggctgtccattcattcatatgtaagtggcacattcttcccatactcacacatatcaaagactgcgtgggacagtagggaagggggggttgcgaaatggacctaccactgcccaagcccaagatgcatcacagagtggtggtcctcgtgcccaggatggccttggaaagggttcttccctcgggcctgcagatcacgcatggctggagtgaacgtcggagtcagtggcggtgatccctgctgcggtttctgagtcgacatgatggggaacgtgagtgaacgcaataattgaacctttggctcttgagtgttgaagacaatgcatatgatgctcgcggcttcaagacccgcgcggttcgcatcattggtgtgcttgttcgatgactaagtcaccacccctccaatggggtgccagctaagtgattgaagaaatgagccacctaaggtccagtcctgctacatctcgagcaatgacgaataaggtattgttgattacttcgtaagaatgataaacaaatgaccatataatgcactctatgtcatcgacttgtatcagtctattatttcattctgtttattgaagattgtactctacttgcacttgctcatcaatctcgtgcacccatttggctgctcagtttcgttcgcatttgatttagttaacttaattagtaaagatttcatgaattacatcctaactatttcctttattttttgtacagagttgcactggcaaccaactaccagcggacaccgtcatcactcattcattgccttcccacccgcactgctatgtagctccaaccatacaccagttttgcctctatcccaattcatcgtctgaaaggtagcgggaagagagaacgaacaataacatgggaacagtcgagaatgagatgtgactgacagaagaaacccgaagaggggaagattgacgcaacgaggacaccccacaaacactcgcccacccatgtacccaaatgccatttccgaagcaacccgaatgttgtatacaaaagaaaacaccgagatagtaaaccataccttcctgctgtggttgcgcctaaccggacacgcgtcgtctgctcgatattcgaggcgaaaagcgcattgtttactcaaagccgcatagaaaacccgataaaaagagaacgtgacatttgtggaaacgccggggcgtattcttaagtaatgagtgtagaccgtcatcatcatgactcacttgagcggttggttgattatgccgtagctgagttcatctactgaagttgatcacagcgagctaggtagaaggacttgcgttagtattggcagccaaagaaacggatggcttagcttactctggaatttgacccatatgccaatttctgtccgctcgcgtcccaacataggcagtgctcatcctcttcttccgattctgagctttctttggggcttgaccaccccgcatgcgatggacgtgtccacgtagctcgtggaacagccgtgttttcgactttccatatcagaacttgagttgacgtggcgccggcaataaaagcgccatccggggtaaatgcaaggcggacgattggagagcccatggtcaagaagcactttgttttgctctctggccttcttgcattccatatcaaaatagcgcagtcttcacctccggtggcaatcagtcgctcgtcgtcggccctagcttgtgttggtgatagaggctgccacgccattgtggtaatagggccccggtgcgcggttatcgatttccgctgcccagcctcatcccatagctgtaaacgatcagtatattgggtgacgttgagacaaatcaaacgacagcaaacttacatctaacacacccttctcgctagaagttgcagtgattttcgtcaatggatcatacagaacctgcctgaagctatcatcttgtctggtctcgtacttgcgaaccagatctattgaagcttccccaacacgtaggcaaacaaacatgtcacctccacccagaagaaactcgttttcgctagtccaagttgcatccaggctgttggctgtcgtatcgtaacctggaatcacatacgactttgcagcacctgtagaagattcatacaccgtgacaatagcgccggttttctcgggcgaaatcgatagcagcgacgtgctttgcgggctccaggcaagtttgacaactgggggctcgctaatagtgagtgtttgaagaagcattccatcagacgagcagatattgatcgcagcctttgatcgcatgtcaactgcgaccgccaggtttagaccatccgtcgcccaggcaagtgccgtgaccgtcgtgttcgaaggagtctcaggatcgagcagcggcagtccatctggagaaacgtaaccgttgggcagcttccggtctggggcataaccacggggaattgaccatactcgggcgagcgcatctgtacctgcggctgccagcagagttgggtctttcgggctccattcacactgcagaaggatgggtgcgttgttaccgtttaccatgtcgtcactctcaatagaaattagggagtcgtttccgaggcgaatgaaggtggtgtctggcaaaagctcctcgactttgtctacctgcgtcccttgctcggggccgtcggtgtgtaccattggcgtggtagcctgctcgccttcgagtggcgacgggtaagcgtgattatcctcatgctgctgctgctggtgaccttcctgtgtgtcaacatccataggggtggtgccggcacctgcatccagcccattctcgggactgttgccgagccgttggcgcttaattggagatccatggagtagttgctgctgatgtcgtttacgattaatctccagatcctcggagggtggcgcggtgaccgtggcgggcttgtttattgacgcccgttctagtgcagcgccgacatcctcaatctgcgctgggggttgtgtaacaaggggaccgaaaataccgaaatccaacaaatcatgctctaaattcgcccctcgggatagctaaccatcgaattagtttttgttttttttctcacttcatttgggggtagaaaaaaaaggctatccagatgcggaggggttgaggctaaaagcggagacgggtgatgaaataattcaatgaaaatgaaggccgaaggggatgagtgaaccctattcaaagtcgttggtggtggaagtacctgatttgcaatatgttggcgctcaagcgcatgataaagtaagccccgattgatgatggataccagcgcgtggccttttacgtggggtgcgaaaggaaactcttggtgaggttccttgatgtgccactctttttgaaacttggcggcagtctcgcggtaatctatggaccagaaacaagggcgtggtcagattagctgttcatctttgcgttactgtcctgctgggcacgcagcaggtgattgaaccaaggcagagaggcctgtggctggggtgcaacatactgcattcaagcaaatacctgctttcgagtcagtaaaatagcgccagatcaattcagggaccgcggtcatgaggctggctggaggcaggcacagtgcatgaggcatggtggcagcagagagcgagaggacgggcaagaagagggagatggcgaactcaagtgcagaggggatagatgcggtccaatgcgccgggtgggacgaacctccagacgagaaagttgactctgtccgagtcgatgaattccttgacaaccatggtaggtaggagagaccggggcgcgcgcctcgaagggcgcaccgtcgcggaaggtcgatacaagcgcttaaaaagcctagtgagcaggtcaaaagccggagccgggtgctggggatcacgggcaggatgctctcgcggtccaagaggcctgagtcgtcggcggattgcgatttggcgatgtggtgcagcaaagttgaagattcaagaaagagatgaaatcgaatctcaaagttggtgtcggggcagcggtaagttggactccactccccttcctttctccacccgcccagggagggtacaacgtgcctgacatacattgcctcacactaccagcttcctcagtggtacctatgcgcctaccgccactgggtagggaggcaggttccctcgaggtaccgtccgtggcccagccgctggccatgcactgcagggctgctgagggcactggcggaggtgccacccaacctcgacctcccaaacctcgaagcaagacatatcttccggtacaacgtgcctgcaagcccccaaatacagcccgacacgaaccagccagagcgcaagatggctaggagaagtaccctgtcttgggggtgggtagggccatccagaagcaacacacggatacatctaggcgatactgggtggggctagtccaaatacaggacaagcgtgcctatggagcgatatcgaaggatacctagatggcggagaacatcactgagaacacgcaccccgtcgacgcaggagtcatttggcccagttcgtacctggttgtgctctgacgagttcgcatccgacctctaattttacactagaccagccgctctgttctatgaaggcttcgattcattttatgtcgatcagctcgcccagcaaattcaaatgctcaccccctacgcccctacctagcgaaactctggggagcctggtcctaagattcaatgtgtgcccttattatgatgtacccactaccgcgagctcctggctgtcgaccgcgaatacgatacgagcagcatagtctttctacataggcaggcagtagagatgccgtccctgtcctcccgtttgcctaccggcgcgtggccgcgcccctcgtgtcaatgctggggatccaagctgcccacaatgagccgcttacgaaaagcagatggggttccagagtacatccggctgtagaggagcgacgtggaggctcggcaagttcttagcgcagggccctttcttcctcttcccccgggagcggagcccaaaaaaaaacgtacctcaatttaagggtacgtaccagttgtgccaccatggtgctgttccttgttcaacacctagccactgagtgtgtcttggcgccccgacgcatccacaaaaggtgcgacgcacatgaacctctccaacgattccgtgcgcaaattcgccggtcaacatcctaggctaccgtcttcaagcaacttcaccttgagcccaacaaaaacaccgggctggccgctctggtagttgcaaatgtgaggcatcggacgagtgacaaccctcacgcgtgttgcagagggtgccctctgactcgcccccaccgcacctgggttggcaggcctgggccgagaaatcctgagaccgatcactgttgcagatcgtaaggtttagcacggcagctagcaatcaactgcggtgactgggacaagcaacgggcgggactttatgatgcatacatgcgcaaactgcctagcgagataccggcctgcaaggtgcgcctctgcacatccaaggggggcgaaccagcgcaagcctgcttttcgagaagccgagcggaggcatgtcttccttttgtaatatttcaaccttttcttttaaggtcaatttgaagattgttaaccctggctccgcctaggcctggggaggggggcaaattatgggaagagcgggtaataataactcgtcccaaataatgggctagaaaaggtcagacgcgttattagtaccttcactccgccccccctccccgaacggatccattcaagactgatcggtactcccctttcgtcgcctctggctgctggaggatttgcagagccagaagttccgtcggcccaacccatcgctctgccatctacttcttcgctaaggccggccagctcgacataggcctcgagcggattgattccctcgccagcggcactgtctgttggtgcaatgcacaccaatcatgccctgcatccaggcctgcagtatcagctcaaacaatggggttggcgtctgggcgctgcgggaagatgtaggctgcagctgtgtggcagtcgtcatgagcgacccaggcccatgcttaaagggtgccgccagcaaaccttgcccacaccatcaagccttggcttgcctggcacatgcgcagggtccacctccgtccggaccagtcaagaggccaatgccgcaatctgcaatgtacccagcgatacgtaccgatttcatgcgcaactcttcgcttcaggtgctcatctctctgcagggatcctcagcccagcctagtattccctagacacgtatgtaatatcgtgacctgccctgcctgcctgtcccgtggaggaattcaaagatggggctcggagggtatgtgtgcaaacgctgaaaccacttgctgaccgccgcgcttaactgccagtgccaaccatgtccaatgcatgcggacgtctgcactgctgaactcacacaaggattgctcacttcggccgtaggtcggccttctgggtgctgtaatccttgcttcccgctatctttgggctgtatccagagctgagatcaagcaaaacaaacgtgacagccccttccgcctcctgccccggtgggcggcttgctcctcggcttagcagatgcattgcataacgcctaaaaaagatctgaccccttccttcccttagtcgcccaagtgatcatccatcgggaggggagggatcacgttctgtcatcccggctccaaatgtaggctcccgtacatacatgatgcacaggcaatgaattattttaagcagtgcctgtgatgctgcgggctcacgaacaggagcactgacaatttcatcattctaatgtggacccgataaggttggtggtatgtggattggacaagaagctagaaaatgtcagccagccaatacctgccgcattcgtcgtcaaagacataccaagtgaataagaagaagaagaagaagaagaagaagagcggctggctattgggatcccttcctcaccgccacgtttttgctaatttcacagccgcgtatttgcacttgcaatttcatgggatctcgctatcaatgcacggaggtcataatgttcgtgaatgtggcacaagatcagcaaaagccaacctaaaaactacccgtgctccaaagcaggtgagtttcacaaatttccccaacgtttccaatttgcttcctcaggtatcaacatttggaggtggctggtagcgctgctagctgccagggtagcttaagtttgtggctggtgtccaggggctggatgtggcggtgcgcggagaagcaaaccagatcaccaatttgccgttggtctactgtgtctagcaaatacgtatctaccagaattagtgctgaactcctatcccgtcaaagtctgcgcagaacgctgcccatccaggctccatccagagccatgccacctcgaataaacatcccgccggtgactcgagcgctgctcattgcactgctgtttcagtctattctcagcgccgcaatccggtaccgccaatggacaggaaccgccgatatcctcatcccttatctgacgctcgtccctcaactgtcgattatctacccttggactttcctcagcacttcgctcgttgaaggaaatgtattcaccttgggcatcgccggtgcaacgttgttttacggggggagatatctcgaacgagcgtggtcatcacgggagctcgcaaagttcctagctctagttaccttgatacccaacttcttgacattcttggtcctagttttcttctttactctaactcgcgatgaacgctggacgtatgtgcaatctttgagctatcgttttctcgttggtggggttgctctttgctaatcaagatatacaggctcacgattatcgcgggcacgatccccatccaaatctccttcctcgtggctttcagccagctcatcccagcacacaccgtgaccctattccgcggcatcctgtccttgagagtaccacggtttccgctcgtttacattggtctcgttacgctccttgctctcacgccgttgctcacgaccgcttcgatgtggctggctttgtttggcttcgtcaccagctggacatacctgcgattctacaagaccgtctttcccgacctcgagtcctcacaagctgcgtccctccgtggcgacgccagcgagacatttgcgttcgccgagttcttcccacaccccgtcaagccgttcgtcgcaacgtactcggatcttgtcttccagactctggttgccatgcgcatatgcacacctttctctcaggcggacgtatcggccgcccgtggcgatagcttcctccagcgtggcacgccgggtagtgctcgtgcggaggccgagaggaggagggcgatcgctctcaaggcgctggatcagagattacatgccgccagcgccaacgccgccagtcgatccgcacccaacccccctgtgcaagcgaccggaccgccggtggaaacgcaaccacagcccagcacccaaacagccatgacgtctcagccggctccaatgctcggggagaccaagtttgaccccgaccatgacgacgattccaactcgagctgagccggggtcgagcgtgaggctggatggagtgtaatatgatattgggatatttgataccatggtgtaaccatgggtgagccattcgttaggatgttggctagaaaagtgaatgtccttgattgacttgcaactatacgtgttgatgtattactaggacatacatagcgatgcttttactccgcggggttttgggggttatcggggcgattccaccatatttcttagtttacctgcttatgatactgattttctttggtttggtcaacacacaatcgtctcacattgtctttccgtgacatgcacttgttagggctggatgtttcagactgcgacctccagatcctcttcccaagacagcacgtcatatcagctgatatcaaccggaaaatggtgtggtagaagggtcggtctattcgaaccttgtgaaatctcttgagcgtagccgctgcagccacttattagcaacatgacagcagaatgaaatagtagattgaagggtagctaggtatgtgtaggccacttcatacgataaggagaagagtatgtaccataaaacgatggtaattaatcatcttcagtgtatcgtctttggggtatttgttattgctcgaaaataaagagaacaatgtttcatttggatactgagattagtcaaataccttgcgcacacaagagcagttaatggtgcgaatggacctgcctattgtaaaatacatctaactatcagtgtgcggcggcagcggccagttatattcctttacggttttgtttcagtgacaaagataagatggctctaggtgcgggtgtggttcgaccgagtcgagcggacaggactcccggtatcacttaaaacgccgccctttattaattcacttcctgtctcgttgcttgaccccagcacaggacccgaaatggccaagaggcggcggaactggagacctctcccggttgcgacacccgtctatatcaaccacgaatggaagcaagaggtggatccgaagtcaaccctaccaaattaccgggcctcttgggtttttctcgggggaggtattctaaagcagagtaagtcctacagtgtcatcaacgagactgggttggtgaacgagaactgatcatgggtgactctgaaaaacacaaggccatcatcctacatcctaaggtaccgacgttaacgccagtgcccctgggtcttcctcgattggtaggttcctgagaaaggtggccaaaagtaccggagtgtgcttctaaaaacaggaagcagtgccgctcgtctgcaatccatcgagcttgaccacggtctcaatccatggcatggcttcccgcgccatcagaccacccacgtcgcaagcgcaagcctcactgataatggaggtgtgcctcggcaactatttctcctttggctttcctatggataattcgatataccatggtcaaaatatgtcggaaaaaggaaaaccatttgcctatggtcgtcagaagctaggcatgaggttgatatgccatatttagcacggttgtacccgtagtgcatcttcaaagtacgcactagaagtcacccagcactctccgtaatcccggggggctgtaaaagtccggttgccaggatgtcagatttaactcgggaaggcagcggatggtagagctgcctgacatgcagcagcgccaccctcgttcaccactgtgccgggctgtcttaatgcgacccccttacaggccgatgtcagatcataggagtccagttcggtgagccagccaaagatcaaaggctttatcgcaaagttggccagacgaggcagcaaagcgcagctctgggggtctttatttatccaatgggggagtgggtgctgggaaggggattttctccaggattatagcgatggcggtgggctaaggcaccaggtttagtacccagtaaagcggacgggaattctgcctgtccattacatgggtcaggactcctttaatggtcagatcgcagcacggtgtgcacagcgtcgacgaacttgtacgattacatcaggtcgcctcggctgacgaatggatggttggattatgctggaataagaaaagaacaccaagtttagctcatcgatgacatggaagcccaacggccgaagtgtagtttgatttgttgggggcacacgccggagctagtattgaaggcttaaacaggtgggaactaccaggccatcaatcaaccagacacataggcagccagcataattcttgagcgagattagtgaggcaagtattggactttgatacggcgcagcaggagctgagctcgtttatcactcatcacagaacgatctccgctcggccgccggaacacacagcttcttgctgtgtttagggtgggagaaatcggagggggcagggctgaacataagcgttggtgggggcacttcaaagagagaggcacgcatctgccttggggatcgaactagtacggggggcaatagccacatgttgggatgatgacagggcgtgcgggcaaacgggggagccgtgcaagcctggacgcggaagtgatttggttccccaagtgcgtgtagaggtgcaaaccagctcgactagaagtgctcaatgacggcagtcgagccgggatcacacgagccgttcattggacaacaaactgggtgacgcaactcccgctaaattctatagtccaaaagcctgagtgatgttggatggatcaagcacactgggagtgcgctgagcagacccgagaaacacggagttcacctttacagaacctgcaagattagccttggatcatttacccggcgattattggactctgacgtctcgctggcatagaatgaagcccttgttcagggaagccaaagctatgacctcgataatttaaatgtgctcgggccaatcatatatgtcactctcgagacggtaaattggctgctgaacctacccccagccaataaagacattggtctggtcgcctgatgagatacgtatgtcagtgctaggaggcgaaaaagcaagcaagtgcgttatcagatatgggcgttgatttgcgacacgaggccgagccagcgcacaacccggccggaaaacagcccggcccctggacatgggcgttgggcggtagctccctgcaactgagctcgtgacgtcgagccgagcagcagagggcaaaacgcagcaggcagcgaccatgatagcagccagtaccaagcacgagattctcatcgggatatttattgcaaaacttaatgtaagactcgcttgtagggtgggtggtggcgtatcaccgcccagggtaatacattggcactattacgtagtggggagagcatcagagggtgtgggtgtgtgatgggtgaggtgtgattgtgggtgtatatgcagtgcgtccagcgtgtgcatgccgacgagagtgccaaaatggtggtggagggtactgacgctggctcaccgggcggccctggcggaccagaccagagctgccgcttttggggggaggggcggtggggtgcatgatactgtgtttctgcacatccacattttcagaaagggatacgtacacggtatcacaggcgacaagggccgaacctcactaggaacacctcacgagtcacagcctctgctggtggttggggttcatgcctgacaaatcgaatccttcagcccaattggcagccctcggcttggggcaaccgtcggccaccttcatgtgcccaacggcgatgcaagtatcgccgtgccctctggcgtcgtcggcgcttgcgtgctggtcgttcgcgtgcgctgcctgcacgcactgcgcggcgaccctgcgctgctagggcgccggcccagctacgagccgagtcagtggaaatagagccggcctggtcgccttcatctcacctaaccttacctactacggagtagaccttgcccggactggaccaacatgaggtacttgggtacctgcccacctgccgacatcagcagccggggtcagattagcgcgtatgtactccgtacctggtgcagtgttgtcttgcaaggggagcaagcctcgacagccgccatggccatgttgcctgcattccaaaaaaagcggagttgatgggttgggggagtttggagccccgcttttttcgtttgaaggagagtttcgctgttccccccttctgttcgttcgatccattcgagccgccttcgttctcccgatccccagctgcttcttctcacctccataggatccaaaggagttggcgcagattgggatcgagtcctcaaccacattggcctaccctctcgcgttcgccatcacttattattcgtacccagcccccatatctttccttacactcacttcactgttttcccccggttccgcgccagcttcacgccttgacttttattttgttccacgtccgcgccagacctgaccgccacacattgggccctcgcgcccagctcaacgcttcaaccatcgaatcagccacatcccggcctcgttagatacctataccagagcttcacaagctgtctacgagttgcccaaattttggcccgtctcgttctcctcaaataatcgagcttgatgcgccatggccaaccatcatccctctcccaccatgatgcaaatacagcagcagccagggcatcatcagggccaccaagcgccccctcctccaccaccccatccccatcagcaagccggccactttccatcatcaggtcatgccatcgcggccgcaaatgaggcagtatggctgcagatcggtaagtctagcttgttctcccaccgttgcgctggctacagtcgtgctaattctctgttcttaggaagctgttcggagcttctacgcgtcccagacgaggccatgcacgcctatgagcgtgcgctaggggccaacaacaactccatcccagccatgaatgccatcggcatgctgcttaagggccgcgaggcgtatgacaaggcgctggaatacttcagggctatcacgcaactcgaccagacaaatggagaggcttgggcaaatcttggtatgttaaacgcgcgttcggccggttcgcaaaacgataatttaaccttttccatgcaggtcactgctatttgatgacggaaaatttgcagaaggcctacgatgcgtaccagcaggcgctagtaaatcttcgagattgcaaggtacgtcgacgattgtccgatttaagctatccgtgcgcctaacatattccaggatccaatgctgtggtacggaattggtatactatacgaccgctacggcagttttgaatatgccgaagaggcgttcggccaagtcatgcagttccagcccgatttcgagaaggcgaacgaaatatacttccgccttggtataatttacaagcaacagtcaaagttcgcacagagtttagatgttggtgacccatccgccttgctaccagctcttccaaaattgacaccggacatagtgcttcaaatatattgtctcctcaccaccttcgccattgtcgcaagacgacatctggtttcaaatcggacatgttcatgaacaacagaaagatgtatttctgcctctctggtcaaatatttttctctggttggatgcttacgtctgtcttagtttgataatgccaagaacgcctacaaccgggttttggaaaacacccccaaccatgccaaggttttgcagcagcttggatggttgcatcatcagcaaagcaatgcatttgatgttcaggagcgtgctattcagtaccttgagaagtctgttggagcaggtatgggaacacacaacttccgcgcgtagagcgcacagactgacaattccccatagacaaccaggacgcacaaagttggtacctgttgggccgatgctacatgtcacagcagaaatatcccaaggcctatgaagcctaccagcaggctgtttatcgagacggaaagaacccaaccttctggtgttctatcggtgtcctctactatcagatcaaccagtaccgagacgcactcgatgcatactcgcgcgctattcgtctgaatccctacatctcagaggtttggtacgaccttggtacattggtatgtttatcagctagatcaaccgattgctcaatctcgctaacacattccagtatgaatcttgcaataatcagatcacagatgctctggatgcctatcagcgggctgccgagctcgaccctgcgaacccccacattaaggcgcgactgcagcttctgcgatctggatctagtaatggcggacccccaccagcagctccccaacctgccgatgtgcatccgcaagcctaccagaccaccgggccagtcggtcctgttgcaccgtcctgggctggacctgctcaacaaccacccagcaacggaccgcatcatcaacagcaaggaggagccggtgacagttgggctcgggggctttcgggcgtcaacccaccacctcagcctgccaacccttatgacagccgtggtggtgatggcttccgtggagctgtgcctcctctgcagcgccagcctactcctcagcaggaccagcaaatgcgaccagccttccctgagcctggccgctctgcaccaccacctcgtcgtggtcagtcacctggtccttctagccatcaatattcccagcctcctccatcgcagcaacagcaaccaccaccctcacaaggtccggctctcggccctgatgcccgtgtcccgaatcctaactggggtggccaagtcccttcagtggcatcggctcctccctcgggccattcgaatggagtgaatgcacctaacggtgcaacaccattccgggctaacaacagcccgcgccctgacggtagaccgcctcatgagaaccgcataccttctcctaagacagcctacccgcaacacccaccgggtcctccttacaatcatcactcagaggcaccgcctcaaggtgctcctgagagtgctcatcctccccctgcccccttggccgagagccacccacagcgaaccgaggagcggccaggctctgctggcccaaagcgagttcgggagtgggaggaggaatctgccgtcaagaaacaggcgaacgaggagaaccgtgctcgcctcgaggatttacgtcatcgacgaccttcaacgcctccacgcgagcgtgacccctaccgtcgcaactcttctgaagcgagacgcccggatgagtcaagacggcctgaggagccacgtaacgagggttaccatcccagtgaagctgctcaccactcacagaaccactctgttggcccgcagaatcaccacccaacaatcccacagggtccggcacctgtttctactcctagctctgagaagccccctcatgccccaccggcccctaaggatgagcgtgcggcatctggtgagcagcctgcagtttctcgtcctgcagcccctaccagtgagccggagcgggctgcaagagacattaagatcaatgatgactacgacgatagtggagatgatgaaaagaagacggccgcactggccaatggatccggacccggatctgcttcgggagatgctaaaacatccacaccaacaaacggtgctgttaacgggactccgggccctgcatcgaaaactgaataatccacaaaataggttcccgagacttttggtttcctaatttaaatttcattgttttggtctcagctttattatgtataccaccaaggacgtttcgtccttctattgatttgtttctcttttcggatgtggagccgcatgcggaagaggcacgaaacgaatttccctccatgactttggctacaaaatcatgctcgccctgtcttggcaacatttctttatagccgttcaacagtgtaactatgatgaatctataccagacggatttcaatttgatctctagcctttccttggctctcgtcccattgaagtgcatgtttccgattagtcatccatcagggtgcaagcatcgtcgactaatcacgtgatcacaatcagggtacagctcgaatggaaatttttggtgtgccagcaatgtgcaaccttgccgtttggggcttggatcgtgcacgggccaaccacgaatttgtgcagttctcggttaataaaatttcgcccacaaattgttaaaaccctcttctactcctactcagcagcggttttttgtcactcccatcatactaaccttcaccaccaacaacagcccaagatgagtgtaagtaaaatgtccgctcaatggcaattgatatgtataaagctgacatttggatagcaccgtaagtacgaggctccccgccacggctctctggcttacctgccacgaaagcgtgctgcccgccatcgcggaaaggtcaagtcgtaagtttgaaataccaaatacaagaaaactctaccaatatctctgggagacggaaaacagtatctaaccaatttgaacaactcagcttccccaaggatgaccccaagaagcccgtccacctgaccgccgctatgggctataaggctggtatgaccacgatcgtccgtgatctcgaccgacccggcgccaaggccaacaagaaggaggttgtcgaggctgtttcaatcgttgatactccacctgtacgaacaatgcagcccgcttggctatgtgcctatggctaacatctcttagatgatcgttgttggtcttgtgggctacatcgagactccccgtggtctccgatccctcaccactgtgtgggctgagcacttgggcgacgagctcaagcgccgcttctacaagaactggtacaagagcaagaagaaggctttcaccaagtacgccaagaagcactccgagagcagcggtgcttccatcacccgtgagctcgagcgcatcaagaagtactgcaccgtcgtccgtgtcctcgcccacacccagatccgcaagacccccctcaagcagaagaaggcccaccttatggagatccagctcaacggtggttccatcgccgagaaggtcgacttcggccgtgagcttttcgagaagcccgtctctatcgacaccatcttcgagcaggacgaggttatcgatgtcatcgccgtcaccaagggtcacggtttcagcggtgtcacctcccgttggggtaccaagaagcttcctcgcaagactcacaagggtctccgtaaggtcgcttgtatcggtgcttggcatccttcccacgtccagtggactgttgcccgtgctggtcaggacggttaccaccaccgtacctctgtgaaccacaaggtttacagaatcggcaagggcgatgctgatgacaacgcctccacctccatggatgtcaccaagaagactatcactccgtatgtgttcccctttattcatcgtgtaattttaatatccctccatttgctaacatgtcattcagtctcggtggtttcgtccgctatggtgagatcaacaacgacttcgtcatggtcaagggctctatccctggtgtcaagaagagagtcgtgactctccgcaagtccatgttcgtacacacttcccgccgtgctctggagaagatcaacctcaagtggatcgacacctcctccgagttcggtcacggtgctttccagacccctgcggagaagaagcaggtccagggtactctcaagaaggacctcagcgcataagcgtgtgctgccgttccttttttatcttggtcattgcatcggtgtctaagggtttgtttcttttaggctgggacaggtttcataatggaatgaatgaaaaaagcaccagctagatgggattgatgaatttaaacaaaaaaaacttccctgcatagatgccgctgcgtgtcccttatctcgcccacgtcttcgtttactgcaactaagcgattcaagtgtgatgatagtgcttgtggggtcaggcacttcgctcaaaaataggtgtccacgttggaatagatagtaggtagttggaaaaaaagaaagccacttccctatcataaatcctagatcgattgcgcattgactggtccgatttattgctagtctctcccgtagagccttgaaattcgtctgtttcaaggtgggcagtggaacttggcgtcttgacgtcacccctcagcagcttaagcaatgcagtgacgcctggaatcgcataaagtgctactacttcttggacatgccttctccattccacagttctctatcaccagttctgccgcgccacctttgtaaaccacgactagccgatatctctaccctcctctacagacgagcttctctacgcacgcgatcattgcacaccacgccacttgcccctcaccaacgaacactctctacatttgcgcttatccattgccgggttcaagccacacctcaacagccagctttccaccagatccgaagtatggcgagtgatagcgactacatgtccttcttggacaaggcgaacgaggatgtttcaggtggaggaaaggcgaccacgcagtcaaagggacacttccagttcaaggcgacagataccggggccaaggtgcccaaggagatcaaggatgctatcaaggacacattcatggtcagcgaggctgacgagcccttcgaggccgtttctttagaggtcaaggaagactcgttgcctgatgaaggtacgtgaagtgtgcgacaggttcgggccatccaagaagcctcccgcatccccgcatctagagatggactcctcttcttccacttttcctaccacccgctgtctgcgtatatattaacggtgtgcatttagttcaattcgcagagctcataaaccattgggaccccaactcagcagacatcgagattcttgatcctctagattgggacaagaagggacggtatacaaaggtgattgaggctgttcgacaagctactgagggcaacgacgtgagagtctaccgcgtaccaaaggatgcaaccagggcagaatattggatcatttctgtgtcgggtggccgagcagtaggagtcaaggcgttgagcatcgaaagctaaattgaccccatggtggaggcgggggaccacgccggtacaatggtctggcacgatgtgactaacactgatactgcaatttcccctagatggctttccgcgattgaccgactagctagcaagaaagagtcggtcgattaatgagcatctcacctgagacagagcaatatccccatgactcggctggtgggacaatggtgccgattgaagagtcactgagttagataagccctgcccgataacggcggggcttacaagcaaccgttggtaaatcttacagccaaatgttagcagtaaatcagtcatatctaaactaggtgaacccgtccgtggaatttcctgctgtctaccattcggacaacagtgtgacgtctttgctgttcctaatacctccgtatcgtctgttattccgagccagagagggaattcggtcgtttgtgcgccatggccagcggggtgggtatctgtttctttcaagagtcaccacatgcctgcgatcgctacagcggatttcggttcaatgattgtgctaattcaattcgccattggctcttatagcgagatattgtgccgtccctggacacggtccggcaggttttaactactgcccgcagttccagcagcaaacgacaaccgaacctcgtccccgtataccgccaaatctcctccgatctcatcacgccctccgcggcgtacctcaaggtgagcgccgcctcgaaagacgacaattactccttcctcttcgaatccgcagccaccgagcagctcggacggtatagctttgtcggcgccggccctcgcaagatcttgacgaccggtcccggatatggcgaggagacggatcccttgcgcggtctggagaaggagctggcagggtatgtcgtggcgcaggtccctggattgaagctccctcccatggctggaggagctgtcggatatgtcgggtacgattgcgtgcgctacttcgagcccaagacggctcgtcccatgaaggatgtgctcaaggtgcctgagtcactgttcatgctatacgacagcattgtcgccttcgataggttttacggcatcatcaaggtcatttcctatgtccaggtacccgagggccaggacgacaagggactggaggaagcatacgccgaggccggccgcacaatcgacagactagtcgatgttctcgaatctccagaggtcgtcctccccaagcaggaaccgatccagctcggccaggaatacacatccaacattggccgcgacggatacgaggcccacgtcacgaagctgaaggagcacatcgtggcgggagacatcatccaggccgtgccgagccagcggttcgcccgcccgaccaacctgcaccccttcaacatctaccgccacctgcgcaccgtcaacccctcgccgtacctcttctacgtcgactgcaaggacttccagctcgtcggcgcctcgcccgagctcctcgtcaagagcgaggagggccggatcatcacgcaccccatcgcggggacggtgaagcgcggcgccaccccggaggacgacgagcgcctcgccgacgagctccgctcctccctcaaggaccgcgccgagcacgtcatgctcgtcgacctggcccgcaacgacgtcaaccgcgtcgccgaccccctgaccgtccgcgtcgaccgcctcatggtcgtcgagaagttcagccacgtccagcacctcgtgtcccaggtgtcgggggtcctccgtcccgggcagacccgcttcgacgccttccgctccatcttccccgcggggaccgtctcgggagctcccaaggtgaaggccatggagctcatcgccgagctcgaggcggagaagcgagggatctacgccggcgcggtgggctactttggctacgacggcgtggacgagaggggagccgaggtggagggcgcgatggacacgtgcattgcgctgaggacgatgctcaccaaggatggcgtggcatatctacaagccggtaagtggttcacaaggcatggatgggccgctctatgagagcaggctcttcaccttactccccttttttacttgatagcacacaagcgaatactgacattccccttttcttttctctaggcggcggtattgtatttgactcggacgagtacgaagagtggatggagacgattaacaagcttggagccaacatgcattgcatcacttcagcggagcagctgtatcacgctcagcagcaacggtcggcttagacagtctgatagattttgaaaaagaaatataaaagcttgctgttcctacatatccactgtcttctaacgaatgattttgagctttcacatgcacaagagggatgattcgatgatcttagggagtgaacccaatgttattctcagctaactaaaaactaaactatatgtactgtagaaatccaaaccaataataaaatgctatgccaaatgccaacaaatgcccgtgttgtaactccaaaaatcaaccttggctgaccagatgttcaaaccttttcccgtttttgggtcgtatctcgttaagtaaataaaaaataaaacaaagataataagaaatgatgaaaaaaaatacattagaataaaaattgcgaactgttagatgccagggatctaatcagcagcgcgttgagttcttcacttagacggccacaggctcgtctctggaagtggccagctcaggaataggtgtatctcgtttcttctgcgccaaaaacttctgttggccccttggtgcaattggcgtcatggcaaagtccatgtcctgctcgacggaatgcaggctctcggtatcaaacgagaccacactgctgccgtccgtcatctcgacatcgttgtcgttggaggcgtcggaggggagttcaatggagggaatcggagcctcgcggcgcgcgatttgtgggataggtggtccgatgggtgtcatgtcctccatcccgctagtcctaactttaggggttgcagcgtcgcctcgaggaacttcaatttccacttcttcattgtcctggccgatggtccatacccagcgtcggggcttctcctttctgctcttcctcttgcgaatgcctgtgggagacgcagcagctgcggatttcgggacgatgggcttctttggtgcatctgccatgtcagaggagggggaggctccggcagagtcattcacacctccaggagtggaaggcgagaaaggagacagtggagaagcgtcatcagtgagcaggtcgatgtgtgatctagtgtaggtgtttgtggtgatttcctgttcgagagggctgttgtaccctaccctgcgagctgccctctcctgcaggcgcagtgactgccttctaggtgaagggggaggaatggctgtctttgctggcaatggtgagttgcgaaggatgctatgacgagcctgagatggggtatatggtggcaggagaccaggagcagagggttgatagacaatcgtgcgtggcttggtgttggagtccgagtggtcgtacagtctgtgagccagcttcccatgggcaatgtcagtcgaggcaaaggtgaacactttggattcatttgaatctctggttcccgacagaggaggagttgccgtcatagtgctaggatacttgatctccagttgtcgtggggatccagggtgagctgaggtaggatgagcagagagaggtgtctcggggtagtgcgtcgtgtacggggtgttggcccggttggaaggatccggcttctcgatcggcgtcgcaaggctgaaggcttgaagggtgttgatggcagtcagaggctctgcatgagcggctgtcaagccggaccttccaactacagaagcgtaggcattggagagggtgttgaaggctgtaggatccttggtgtcgatggtgggtggtcgtgacactcgagcgactggaccaacagatgtctggatcttcagagataaacggggcctcttctgctggggggatgccattttttcgtttatcgagttgtgagaagagaccgaggcaagaataataatcgcaggcggtgctaccgcgaagaacaatgggtaggtattatagaggagggctcagacaatagtaaggagccaagacaacagccgtatgcaggttggaagaacggttggtcgagtttcagagtcgtagccgccgagaattatgaaaaggaaggatgtttcaaggcggaggagactcgaaagatgtaagagagacggaatcagacgccggtagccaacatggtctgggagactccggcggctatttgacgatattatatgggcgggttgcacatcggcggatacgacagaacaccacggcacaacggtggccggccaaaaattgagccggggtcccctgccctggcgtggtaagcgccatggtcccccttgtatgcaagtgtcgtcacaggaactggctgccatgataggctgtgtggcgggctgcagatgctatgtaagcgcctgctggggtcgtggacaggggggcggacccggcgaagagaggcggcgcaagaaggtggctgtcgggcattcccctacttgctggaggcgttgcatgtcgagacaccagctggcgcagatgaccgaccgcagtcatatctgctaaccagaggccgtcaacggcgacgatatgtgatgaagagagtccgcctgtccgtctggagaggctagcgggggtcgcgtgatgctcgggaggggttgcaggtctgctctgcagtatcaccgtaggatcatggagcggagacggattcgatgagttaggtgacatgcagcactggcccaaccaatgagtctccgctggttggcaggaagccacaatggctgttcacagcatgcatcaatcttgattgaggccaacaatacaggattgtaggctcagcagccgacttctgattggggcggccgcgcgcacccgtccaccgatgacgcgagggcaagagcgacggcgcaatgggcgagcagcgccttcccccattgtgcgccagtgttccattgctttccaggccagacagccctctgctcacggaacgtgctattttctgccgcacttgattattcttttttaatcgctcccgaccagcactacccggcaattgagatcgtgagagggaggcgactcggggtgcttctaattccagagccggcagatctaaaaacggccagaatttccctactggagcggcccacgatggagcctggtaaatcaacggctgggggggcaggctggggaaggaagaaagaaagcaccaagaacgagggcctaaaatcctgccctagcctcccctctgcgccctggagactcacccaacccgccctacagggcctatcggtctctcccagccctctcgaccgtttagagccggcggcgtttaggggacggtccaagcccttccctgcactagtagaccctggccgctggaggattaaacgcggtctcaccgactcattggatgttttgccgtattgggggagagcacggtcggcctgcttggcctcggagactggcaatgagcaattaggcgcgacagatcacaagggcagccactcacagcgagccaaagtcccccgatgcctcccaccatctgtgatgttggctgcataagtccaaacgcctttagccgaccgccgagttaggacctcctctttgttcctctattgatcccccctcaatcaatcctaccctacctagttgaggatcaagtgggcagacaatgcaatgcgagtcacccgtgtcctcctggctcagctcgaccgtctcgccgcatcgcgttcgagcctcaacttgagattcatttccaatttccatagctgagctattcggggactttagcgcactggcctgctggtcatagctctcgcccgaacatggctatttttgttcagggcaggtggaatagctcaagccgtcaactatgccaaaacgattagtgtgggggcaaaggctgcccgaaaaggatagtgccagtattaatagcttaataggttcttgaggacaaagtccaatttattcgaaataatttcggcacatcgccatcaccatttctgtgcggcgtatgcagtcaactcaagtgtatcagatcaacttaaatttgctcggcattgcatgaaccatgggcttttgcccctcccctttccccccatttgtaccattatgactctacacagaacgccacgttaaaaaaagccaccggactgttgcctgtctcatactaaaataaaagccactgctgacgtatgttgtttgaggttgagcgtattgggcctcgaagtcgtagttttattattatcatgagattctagtggcatgtggtctcttaattgccacatgagcaagcagccaacagaatattcaccgatcttccttgaattcttttttcggcttgtagttcgtggggtgatctgcttcgatgatgggggccaaggtgtagggtaggcacatgatctgtaccttgccaaattttggtcaccttattgcctgttagagtataagccgatttgaggccgtgcacgttagttctcacctactattgttgctaggctgtacagatgtacccaaaattaacacattcaagcctcgccctagacactgactcagtgaggcttcatcatctgaatagcaactcagcatgcaaattgcttgctttcattctaagcccttaatgttatggtggcgcctactatgctaacccggatgaatcactttgggcaagctccgacatttacacgatcccctcatccctctcccgcctgtggcgatggcgcggcccccacgaaagctttcacgcaaagaagatcgtattatattgcaattcgtaagccccatatagcccaacggcgtggagtgaaacttcagtcaaacggctcaagaatgtggcgtgcaccaaagatcctacgaaaactgacgaacagggccttaggactatgactgcttctacgcacaagtgtacgaggtgaaaaacccggcactgaagcccaaacctttgggtatcaaacagaagaacatcctcgccacatgcaattacaatgcccgtaggcgaggtgtcaagaagctcatgctcattaccgaggcgaagaaaatatgtcccgagctcgtgatcgttgagggtgaagacctcaccccattccgcgatgttagcaagatcttgttcaacttcttcaagtcctactcctggaaccaaaaggtcgagaggctaggcttcgacgaagtcttcatgggtgcgtcttatcattgtttcaaacccgtcgtatttagaaaccccgaccctgcatctacaatacggctttgcctcgacctcgcatctgacattggctccctggtccgtagatgtgacagacactattaattacaacatggcctgttttaataagcactcacccaccgatcacttcttccagctatctgaaaaggatcccgagctggggtttgtgtgcgatctcacttccatcccgggggctacgattggtggcaatatggatttactaccggatctggacaacccactctacctgcgactggtgttaggatcccacctcgcccatcacctgcgtctgaaagtagagcaagactttggctatacgtcaacctgcggtatctccacaaataaacttctgagcaagcttgtaggcagcaaacacaagccccaaaaccaaaccaccttgctggcattgactgaggaaggaatacttgagtttatgagtggccactttcttcgaagcatccctggcattggtttcaagtcgagttctctcatcgaggctcatgtaactggcctggagactacgactgattctcatagcttcgagtccagagtcacagctgcccaggcgttggcatccccccacgtgtctccagcatccctggaaaccctcttggccgggccgggcgccgagaaaggtataggatcaagaatatggggcctactccatggcgtagatcctacagaggtcaaggaggcaagtgacatcccctcccagatcagtatcgaggacacttttggccggcttgagaccatggcgcagatcttgcccgagctccacaaactgtcgtgctcacttgtgcgcaggatgagggtagacctcctcgtacctgatgggaattccgacactcccggtgctctgaaatggctcgcaaaaccgaagactctccgtctctctgtccgatcgtggcccaagtcaggatccctctatacacaattcaatcgacagtcgcgttcgggacccttgccaagctttgcgctggatgaaaaacaagatatcgaggctgtggctgacagattggtttctgaggctctgttacctttgctgcgcaggctccaggaagacagaaagggacagccgtggagcttgcaacttatcaacatatgcgtgtctaatctggttccaacggcgacagaagacaagtcgggcgtagggagggacattgccaacatgttcagaaaacaagacgaggtgttggcaccgtggaggattctgccgagcccggaagaaattgaaggccatgcctcggaagactctggctctgaggaagctgtcgagccggaaacttgggagacgaccgagaatatacaatgtgacaaatgtggccacgccatcccttactttgctctggaagctcattttagatatcatgaattagaggaggactgagtaaaccttgaaattcaccttgtggtgaaatatgatgtttttgaggagtcaagggttggaaatggttggcatttagggcttgattgagtcgacagatagggttgtacaggcatttttataatggcttagtccgggagcggattaaatattcaaaccagcagcttatctgcacaaggcccagaaatacctttggcttcactgagcgagttgattggtgacggtggaaagggtggtcatttgttacacaaacttggctactcgatagcctatattgttgagatgcatgtccctgataagctatacgaacggatgccctctatgctttgcgagaggtaaatagacacacatacataggtatataaatgagactcagtgcggctggccagatatcgccgtcgaatgattggcactcatctttatccgtgccggctgtgacataattccaaccaagggctattgcactgttcgacggcagatagcatggggagaacggcccgctcttgcttaggattgatcatagttcgaggccggcctcgagcaggaggttgccgtacgggacggaagggtgcatttggtttacaatgagtagctggaaagtattgcaagggtgcaaatgcaagtgtccgaatatagtgccagaattgctttttcgaccattggcggctggtgatctaagtcgataggagggtttcacagtcgtttctattcgctgactgatgggtaggtacgtttaacagatgctacgcgggagtgaacaacggttgttgggagaacgcccaacttgctggcggggggacttggacatcgtttcctgccgggtctggaactgtcctcgcacaaagggccggtgagactctgctcgccactgaattgtcgctttcctgcacaagtcaacgctggacccctgagatgggcgcgcgacctctctattactatggggcgtggcttgcgatcacacaccgtgtatgtagctacccgcctgcgtttgatgagggaacgaagtgacttcgatgagcagcttgggcactaacgggtacgtcacactcgaggcgtgctgaggaaaatgtgaacagaagctgagggacgtatcagacggctggcagctggacacagctggtgacgactgagtgattgcccgcgcctgcctgcccatttctgccccgtcctcgcccattgttcctctttccttccttccctttctgctttcttctctgcgctggctcttgcttgcagtttattccttccctcattcacctgcaccttcctggcctggtcgtcgccttcagcttttagatgagtccatccaaacagtgccgcttccctagtctctccttcctggtattcccaggcatcacgcccatctcggatgatatttccttgtcgagtacgcctggtaggtatccaaacttttcgttttgttgtttgcgcgcccatcaacggatggtgccttccccatcctcactcaccttctcgctcgcctaaagtggctgaacaactacactggattcagctcgcactttcctcgtccggtctctatgacggacacacggggaataaatgagaatttgggaatcagcactccaacacactcctcttctccccttgactcatggatccctcgacgtagtgtgcctgcgaaggtatattgcaggcagttccgaaatcaaacaagccatcagggtttcccatcacggaagtcactttctaatccccatacacctaccttattcgtttcaacaccatacatcctcttaatcgcagcttccgccgtactccccgtgagttcccaaggtcctgggactggactaatcgtctgtttgccccgtagcgtagtagagtcgcttttcgtcctcccttctgctctatgtctgctggcctgtgggcttctgctttgccctttcacctcaatttcgggcggaagtgccgagtcctcgagtccgtgttctgaatcgaaaactacagccgaagatgcctcgaggatcgggccgtggcggccacgggcactcggctcgccgtccagtcgacttgaccggaatactcagtgtcgcagagcggaatgacctttcaacacttgtcattgctatcacagagagaatgcacacagatatcagcgcgacattcgactcgccagtggtgacacccattgacgcgggcaatggacatcacaactggctcactttacctctcctttgccacaaggagggcaagaaagacatatcgtcagttaactccaagccgaaacatcccaaaaagagaggcaagacttataacaaagtctatagcaccattgaaagagaagaagaggaggcgatgacgcctcaactgggagagttgaagaaagaagctttgacgtttttccgaaaatggcagtccttgatcctccaacgtatgaaagatgtagctgtgaccgaacctaaggcttctcatcccggcgggagaggccgtggacggggcttccgcggagatgatagcttccgtgggcgagggggacgtggtgggaaagctggccgcggaggtctcactctggcaacaggttcgttgtttttcttctaactcgagataaagcgttagctgagaccggctaaccccatcgtaccaggccctcctcgactcccttcggcgcatatcgacttagaactatccaagcagtacccgccgatcccaaacacgctgtggtcattgtcaattgaccgaagaagactgtttttccacattgtatttctgatcacactctcgcttcaagagtacacggcaaactcgttcctgcttcttgccaatctcacttcatgcttgaatcttcctttcgtattttttcaaacagaagagattaagttggcccgaggtctggcccatgccgctcttgagacatcagcagaggccttgttagccctgaagcttgaggagaccaaatcctcccgcaggttcaaaggatacgggaacacgtccgctaacccgaccttggcgaccggcctggagagcattgggctcggtacctctagcggaggctttggtctgacaggcactattgctgcaagtcttctaggggccatggcagacaatgcacggatgcaaaacgcagtatttggcatcaacccgtcaaagccgttggggaaactgctcgagaccttcagccgcgacattcaggatgttgggttcataccagtacaccccaagccttttacagagtatgccgatgctcgcgaagttttggcagaggatcgtcggctgcgtgtagtcatcgccctgaacggttgggtgatcgaagatgaagacttggttaaaccatggatttgcttgggacagcaaacggaaacatatactttgagatgggacatggcgaccctccttaatctcgggaactccctggagaccgtcatcttgagctcagcctggggtgtctcaaagaaagaagtaaagactagaacgagtaagttgccttgcaccaactacgagagagcaaatatggctgaccatatctagtcttcaaatgtctactcgaatctgattggcctggatctcttttgaaagttagcaagatcatcgacaatccatggaatgtcggtctcgtacgagcagagaaggcagggggcatgctggctgatgccatcatgcgccacaagtttcagggagatcggccagtttccttggtgggttacagcctaggagcccgggctatttattgttgtcttatggtgttggctgaaagacgccattttggtggcattgaatctgtggtgctcatgggggccccgataccctctgaaagccgtgtgtggttgaccttgaagagtgttgtcgcagggcgtctcatcaacgtatattcggagcatgacttcctccttggttttctttgccgattctcaaacacagacttcggtatcgccggtttgcaagaaatccaaggagctactggcgtcgagaattataatgcgggcgacttgaccaggggacaccttggctaccggtctgctgctggacggattcttagagatgtcaagtgggagcaactgagcaagaatggggcccacggggggaagcccgctggccacaaaggtaggcgatgaaggttatatcgagtggggttatttgtattggctctgatcagggccgggggaatgaattccgtctgcggccaaggctagtcgaatgattgatatggggctcttagcttctgtggtacgattgatgatttgtaaaatagtttgatcaacgcaagagatagtgtgacctttaaaacttctctccgtgctgccttctcgcgttagtgattatgatgcctttcacgattacggatgggggattgagtgagtcgtcaatttgcgtgttccatattcagttgccaatcggtctactaataataggagtagcagcagaaatgatatcaatattgtccccgtcccccaaatgaaaaaaagggatgtatatataccaccgttactcccctaagatgcatgcaccccagttgatgtaaacaaataatccaacaacggggccagattcctgttgaaaaagatggccttttctttccctatagccttctgaccaaatgcacttttcgccgcaatatgattttccattcccttcaatacccagggcttcttgtgatttcaaacatagattacaaaaaaggtcgtttgtacatttgacataacagaataacttccccccccgccatgccgcctgcctcgcaagccgaccgagggagaagcaatgtgatccaaatcatgaagggggcgtaggacccagcatgctgggcacctgcttccggggaacaacctttccgccacggggatctaggcgaggtacgccttggatggcccggggctcccgcatcaaagatctgtccaagcgggctggcgtgcgtgttacaatcgcatgatagtctccgggaaagttaccctttggcacgggcactgaagctgtccgccagatatgatctgaggtatctgccagataggtgggtgattttgagctaccccggcgcggaggaagaaagccgcctacgttgagcgaggcgccgtgagactggcggatggttgataggcgggaaaagcccgccgaaagccctgggcgtcctcgggctttctttgccatgattacttcctcgaagagatggagagatgggtctgtagaaggcttgacctcccgatcatgaataaactcattaaatcctacaaatgaagttagttggtcggttttttgagggatgctagcggagggcaacgaaccttgggtttcgcgaagcatagtggtatactcctgctggtcatagggtagactcttgatgaaacctgccatgtcaaaagcatacaactggccgttgctcttttgctgcttgttgggccgtcccaagtacttgcgatacgtgtataggagactggcctggcagcgcacaaatgcggcccgcactcgatcagcgtggaatgcttcggggcaaaccacagagacaaatccgagacatctgccatgcgatttaaccttgcagcctgagcaagtgtatatcccatctccttctcccctgtcttcgcatatggtgcagttcgacacgtcgccaggggtccagttcaaacaatgtccttcaacccagactgtggtgtcggtattggtaaccgggtggatttgcatgctgggcatgatggttgacgcagcaagggtagattgcgcatatgtcgaaggtgcataaccaccgccaaaagacccgagcgaatcaacggaaattgccgagatcgatgtgtttgcttggtgaccgttgaggaagggcatgttgggccggccagaacccccatctttgccggccatgccaaatgacgagctacgccttcctgaaccttccctaaaatgacccgatcgcttttctctcagtgtcgcagccaaggcaaacccggaatcgcttctggaaacgggggctggtggcaacggagggaagtgcatcgagactggagattcagaggatggcgggctggtcttgttggatttgcttgtgccaggcctgtctgactttgcctggtccgtgggggcgattgcaaacgcattgaagacaggaggatgaacctcgctggggggatctggctcgccaaagcttgacgaactctgggatacccacttgcccagtgtgccgacgggaggtttgggaacgaagagcgaggcgcattcactagagaaggcgtcgtatgggaaggattccatggcgtaaggagggggccctgtggtgacgccataccggagcttgtgtggcgctgcgacctgcaacagagcatggagttttcttctaatttgccggggtagtctaaacggttgagaagtagcgtcaatcgtgtctttatccaagtctactaggacgtagtcgtcctcgggaagttcgatgcgatcatagcgtcgctcgattccaacaatatatgggcatggtgcttctaaagctgaaatcaatcgtgcgggcaatataggaatgaaaacgcttgcccacttgaagggatagagtaggttggcaagcgcatggcaagctaggtggagcatactagtatgcgaggagaggaatatgatgcgtgattctgacatggcatattcgaataacgccatcacgttttccagggataagcagcggaaaagggcgtacaagtccaccgtcctcgaacctggcagttcgttcgaagcttccttgcgggcgtatagtctcagctctcggatacaaagttcaacctgggtcttagattccaaggggctgaaggcctctgtgcaaagattgacgacatatcgctcgaggggctgccaccgcccaacccgaggggaactaggggggactcggaggatgccaccgtcggtcatagggacaacaatcgccttcagccattctttccagaaattgatgttggcggcgtctctgccaagaataccataggctcttggcacccacagaccactctcacccgctgttaggccttcgatttttgaagcagccccatgtctcaagggccgcagcatatctgtcatcaaagtgatcttctcctccacggtactaatctcatcttcaaggcggtctcttgctggtgagccagagggtatcgttggcagcttcgtaagaagatgcgacaagtgagatcgctcaccggccaagcgcactcctagacttgccgccagctctcgttcctcattcgacatgtggctttgccgccactgctcgcatttccgctcaacaccttccgccgcactggcgctcagtgctgtccagatgatgatcgtgagcccatagagtttagaattatcctccgacgtcatcgtaaagccgtgccatgtcgaccgcggtctatcgtctgaagatacaatctgaatatcattggggaatgcgaacatggggacatagtctgggaatttccctctcttagagagatcttccgtcgcatctttgggtgggtatcggtcgagcaggactggttcgaattgtcttttgagagggtgcatatcgggatcggtatttaaaggctccgggggcggaatcaccgaattataattgctcattcgttttgtggtccgaacagaggctattgggttttgtggtcagtacttgagcgaatagtgaatgcagagaagatgttgggtctgggtggacaaaccggctctgcttgcgccgctatttcgggcagtgctgggttgcctccgcatgctattcatatcgcgaaagcttatcctccgacgtatgctccccttgatgcttttcagaggactcattctcccagattcagcctcgtcggcgcgaattcgctctgctcgcggattgatcatgggtggtctggcttgtactttggctccggcgctgaatgtcaaatcctccaagaaatcctccctctccgcggcgaacttgagcagggccttgtcgaaatcgaagtcccgcatgctgccacctgggacgagcagctcgttgccgctgcttgttccctctgcagacagggtgccggtggcgctggcgccgcctgagctgccggtcctgctattctcgacaaccaggccattgggaccattgatagtactgacggggcgtatggtagcgctgctccggttgctcgaggtattcccgttatcgaggtcgtcgacggtggagagcgagaagcggttgtcgaaggagaccttggaataccggctcatagaaccatggcgcgaatggcgcacactgatacggttcgactggggggtgacggggcttggagagtcgacaccaggctcaccatcttcggcaatggtcgactcgacctggtgcgagagttcgagctggctggcctgcggggcatcctcgtaggcaacggactctacgccggcgatccagaagtagtcggccaacggggtcgacgagccctccatgacatgtcaattgagcgagccgcaaccgaagcccggctggatagatttctgggttgtcaaggagaagttatcccaactttttatcgagtgtgggcgacgtttttacgggggcgctgagggggttgcggttcggtcgctgggcctgctgcacggaggcaggggaaaacggggggtacttcactggtagacacaccaccgtagatagatgcaggctagcttgggcagggactgctatcgtatcgtgcctacctaggttagtttttaactccggccaacgcgcttgcggctacctgctgggacaggggttcagtcagaaggagccgacaccgacaagtcaggcacagggacgaggacaggatacgaagtggcatgaggcgttgctgggctctgggtgtgcgcacgcagtacgtaccagagcgagagatggacgggatgggatagaagagcagagaagagcagagcagagcagacagaacacagcactgtttcatgtacctcaggtagtatccaggtagcacctaatctgtacgcgcaacaggtggaggggctcccaaggctaaggtaggtcaggtaggtgcgaggcctctagcggacgtgtacctgctgcgtgtgcccggcggaaaggttatgtggtgctagcaggtagcacacaggtacctacgttatgggcgcggcaggccatatagggccatcgctcctacctcaaaggagcagccagcctgaagctgctaataaggccatttcctaacggcgtcgacgactttcaggggagatgcatcagctaatgtacgagacggttgctgccacccactactaccgtcatcagccctactagtgctcttctttctttttccagagccggccgattcaatagcacgaggagacgaacgggttctatatatatacatgtccgttcaggcacaaaatttccatttaagacatgccgtctcggcgggaattgtgattggcgatgggttccatgaaaccttgactggcccacgcccgacaggtacccaagcgcagcgcgagactggaatggctgcttgccaatcctgcgggaagtttgtaggacaagctatcgacttcgactacttacctagtacttagtacttagtagggggcgcgccacagggcttgatcctcagttcaggtatgtgatgagacgcccggcgttgatacatatcgagttaccagcgagtgagcgttgagactgaaggaactggctcctcttcccctctatcaaccccactaggaccttacccaagcatgtaagctaacattgtaggctttcgagcctgtctgcgaggcgaccttaccggaatcgttatctgtgcccgacgcgatgctgggaaacaacaccttgagcaaagaccagccagaatattactacatgcatctgcagcccatcactgagatcggtgtctgctaaatgcgggcttgcatcggtggcaacggcacgtgcctggctgccacggcggcacagaacgggaatccaacgaacgcatgcttatgtcggcatattgagaagaaggaagcccgacgctacgctgtcatgagaacacgccttggctgtcagggccatggctttatcatacctgtacctgtcccttgacctcgcccatgcgcttgctcctcgcgcctattccttgcggctcctcccacagcatcacgatgatgggtgtcggtgtatgcaggatcgaaactcatccatccgttcgtacgtaaaccatccctggctcgtccctgaataccccgtccaactctggttcttaggacttttggctatagggagcaggtccaacatggccagatgcagcatgcagcgccacacacctgcagcttgtacctggcaggttacagtaagccattcgcctgcgtcgcatccaccatcttgagcacggatgcagattagttagtgagttgatctagcgcccacagcacagactttgccccggagaggatgctgtcgccgcatcggcttactcttcgatcaggtcaatccttacctgcccacgggttctagtgaccagctgcccattgctagggtgttggcgcaccccattcagtagatggacgtgcgcgcgtatttatgtggattatctacgctctacagatcccagacacgacagacgcaagtaagcactggctggtttgaggttggacatgcacggcagccagccaagtagtcactacctaaaagtagtggctggctgcttgtggaaagagacccaaaaaaaattaggaagaaaacagatttcctattggagccaggtctcctgccacctaccgggaacttgcatgtcccagccggcgttgcaacttgggggcttcgggttgtgtgacggtctccctcccctgtgtgctcaccaagatccccatcgatcaccccctggtgagcattaataatgctgggaacaggactgcgagacgggaaccacctctgccactggaccattcattaagcccgcttgccaccctctcctgaggcgcttgctggaaggagcaagtgaatgccggccgtcgtgttccatgctcaggtactggcgctggcattggtattgtaggatttcggccacgggcggatgggcacgccagccatccttgccatcgtccacggcttggcacccattagtacgagtagaccccgaccccgagctcacaggattgctctggatatggagatggagctggatatggagttgccgtctgtgcccaggttgccgtattgatccagggcttgagctgaggatgacatcagccctactctctcagcaccttctcagagcagaccaaaggcagaattgttttccgcttgtggaattattccactcggccctgtctctgcgaggctctactcccacttcggaatagctggcttccccaacgacgagacccttgcatgccacttggatagtatacttgacatgtcacctccaggccccctccctcgtttaaggaattaaaaagcctctggagggagcccgtggagagcgaatcaactgcgcaattgagtgattacgacggtcctaccctcccccaccggactagcacacctaggagaccagcgagtttcagaacccatcgactccaccattggttgtggaagggtaggtcggggaaacgaacgaactgtcggctgccaaccacctgggttccgggagtgccaggccaaaatcagactcctgcctcccagctaccttcgccggccaggccagccgtctctgtgtgtgccgagatgtgcgcgagaccgaaaatagaaaaggcttaaccaccatcttagtctccatgcgtaccttgcatagatagcacctattcaaagctacccacttgtctgatagacctacatgtcttttggcatgaaaattgtccgagcccctttctagtcagatactaaattggcaaaggagaagaaagagtgtggtaggaacgtcggaaagggatgagtgtgggagagtaagagaacagcctaagaaaggggtagatggctccatgggagggagcatgttggtgaacttcgatcaagccacagccatcccacgccatctacacggctcgcgggtgagataagatggcacgccaagacctccctcttcgtatcttgacataatatctgatctattaacacaacgagcaggtgaatcttacggcaacgtctagtatactatttggtgcctgcttcgttattgctcctactagacgccggacagtcgccccatagcttacatattaggctgaacgcggcgttctggtgtgccgtgtttaatcacacccacttacacggcctcgtatgggtgcatgcatgatgttgacccaggtaacccaacatgtaggtggtgggtggaggagggactggtccgagacagggcccctcgaaaacaagggcattaacgcgtgttacatacgtgtatacgggttcgccattgtacctattgtctgaacccggaggtacgtgcagatataccataggtaggtactcttgtgatatatgtgaagaactaccaggtctgctcgtatccccaaaagttggctcgcttccctcccacaattcccaatgccacttgcttacaagatatgattatctctgtgcctggatgtatcaggtctgctgagccatctagcatgcgcggctgaatacgcccgtccatcggatagcgggacactccctggctcgatatttcatggaagcccgtaactcggcaacattgtgagattcgggagacgccaaccaacagagctgttggttcccgttggcatcagatggccagcatatacatccctcaagttggccattccaagtcaatcgacgtaatatgtattttcgattccccgattcccagaaatcattcatcgtcattagtcgtccatgtctggaaatgctattccagagcttgattcgtagcagaccatctctcctctgctggcgatattcgtacacatgtcgtagcatccattggatggcgggcaatcatacctcaacctgtgcctttgccgcaagcttgcccgttgacaggaaccctcggttgcccatttcccctctccaaccaatacccagcactccgaagatgatcctcccgtccctcgtagccttgacccgggtgccgtcctccttctcgttcacaacaaagcacagctgctccgtctccccaggatgcagcaccggcttcgtgctcccgctcaccttccagttgcagtcccggtacgccagctcggcctcgcactccatggccaccttctcaagctgcatcacctcgtcgctgcagttctccagctgcgcctccaggacccatctgctcctctcctcctcctcctcctcctcctcgccgcccgcagccttgacgcccggcagcgcgctcaccttggtccgcacgatgagcgacggcttgcatatgaactggtacagcttccggaacgtcctcgtgcgcccgctcgtgtccgacgcctcgtagtagctcaccgtcaccgccagcacgtggttcccttcttccttgaggtcgaacgtcaccaccccctgcagcgtctccccctcggcgaggtccagcggtcccgtcgccgcgcccgacagctccagcttctgcgcccgtatgcccgcgggggtcttcatctccgcgtcgatgcgcacgtcgcggatgctcttgcccgagccgtcggggaggtcgttgttggcgcacagcgtgcagctgaaggtctccccgacgtaggcggagccgaagctcacggggaggttgacgatggggctgaggaggaagggggccgagttggtctccccgtgcgagctgtaggcgagcgaggccggcgaggtggagggcttggaggaggtggtggtgctgccggtcgtggagagcgactctggcgactcgaacgggtactgggggacgagggatgggcgggagagactagaggcgcgagatggatgggttaggtatatgtgtgctcctggggggggttgaagtgcataccgcaggaccttgagggagattgcgtgaggctccttcacggcatcgtgggatgggtatctttggtggctcatattcgcagtttcatggcctcgatcggattgctggttgtctacatctcccgtcggcgggagatggaggatgcagccttggctgcaggtacgtcaatcgattttgggtccgctttggagccagccctgggccgtgccgcttttagggcggacactactgtcacatacatatatacctgtctatataaaagcttgtccgactctcttccgtcattagtgatcttgcttgaagatatagcataatgtgtaattatcatgatcgtaatcgcaagcgtaattctatctctagtttcagtttagactaatacaaccgtagttttctttgaaactaagttctcttgctgcttttgtgtgcactgccatcctcatagccttgctgttcaaatgagagtccataacttattacatcacacaagctgagagtctccggcgttcggagggccaggattgtttcagccaaatgccagcttcgttgatcctattacaagagggacgaatcagccagccgtagacagatgaagcagttacgtatgcgtgttttgaccagtctacctaggtacatatcacttttgccaatgtctagctggagtagacttactcaattaatagtctaccgaaaatgaaatgagttaattttttaggggaatagcaaagcgaagctattgattagtctgaaatccggatgttgtcgactacctagttaagattgtcttttccataatcagggatttcaccagtaggtattcatcagcaacgctcagaatcaaacgaaatgcagaatggctcctggaatacgaaactctccctactcgcagttgaagcaagagtatttgcaattttatccattgccgtctgataccatcaaccatcctcgtgtcgtttagaacctcaatcggcaaccataatcggttgagctgtggttagatgaagaaaatcacagccctgggggaggtggtactgcgctgaaactaccacctggtgaccctgaaggtggaggtggcggcggagccgcactgggaggtggtggtggaggagcggattcgctcggtgggggaggaggtgaagctgactgcccaggggctcccggagcagcttgcccaggtgcctgagctgaggcctgtccttggccaccataatattgctggtacaaggcaacatagctgtatattgttagtgaataggtgactttatagaaaacttccataggcttacttctgatagcctccccaagcggcgtaggggtcttggccaccgtagtattgcgcatactgggcagcatagtcggttgcagtagtggcgctggttacgccagggggtgccgggctgttggatgaagcagtttctgaaccatatcgaccatatccatattgtccgctgttagaggaactgcgattttggtccccgtaaccgcctccatgaccaccatgatggccgccatagcctccgtggcccccatgccccccatggccaccatgacccctgtgctctctatgctcaccatggtctctgtggtgacgaggtggacgggctttgtagtcttcatactgctctttaacattggcaatcaagtcctcgcaaagctcctttgccctatcaatcatatcagagtctgggccactgtagcagcgaattagcggaagcttgatcttatggtaaaggatgaaagccgtacgtcacgttaaggtacatgtcttcctcgctctccttgttagtagcggcctcgagataccccgagccacggccctttatctgaacccggcagcttgtttcctgctggatgtgcttgacataagcgccgccatgtccgacgacttgggcgcgcaaattgaaccctgggatgggttcgagatcaataggcaccttttcgaccctccatttgcgcttttacactgtcagcatcatagtttcaaatccaagccaagttcattagaagctacccacgcgaccaaactcatctttctcaactggttcctggtctctacgacggagacgacgatcgtccacgagctgtgggaggtcctgctggataagttctttgaccttttggacagccaactccaagccttccttggaggtgcttgtaatgtgaagatacagcggagggttctatattggttagcagagtggtaaaggaagagtgcacaaccagggcgaaaacataccgctgcggtggcaagagccttgttcggatagtagctccctcgagtggtaacgtcttgaaaagtcaacaatagctcgtacattagagagtaattgaggagtatatagcgtaccagcgccggtgtcatctttaatctaattcaagcgggagtcagcaggagcagagaagggggattggtcgcgagctatcgcgctggtaagcttgagactcttcgacatacacccggccaggcgggtgcatgagctgggataatcagtgggatatcaaaaatatttaccattttctgcgtggaccccttggtcactaggtatcggtttctcaagtcgttgacttcgatgtcctgaatatagtcgccgtctgcgacatacatatcgccattcaacacaggtggagggttagaagcgctgctggaggatgttgtcggctgggccgctggcgcgccttctgatcggataggtgggacgtcgacatgttggatgcccttcttggcctggagctgggcgttgattctggcagcggcggcggctaagacggggtcagattagtcaaacacgaagatgaagggttgtcctgtcatacctgcagctgctgctgcatcggcggcgggcttctttggctcagagccaccatctctcgaaagagggctgcggtctctaccctcagcccgccgagagggtggcgatcgagaacgacggtcaaatcgagacttcttcggctctggttctgtctgatcgaaacgggatcgcttgacctggggtcgctctggttcgtccatctccgcggtgcctcctggcgaagagtatcacggcgtttcaaagtgaattggaaagctcggcagcagtggcaggatgtcgtgcagttccgaggcgcgctcgtgatatttgtagattggtgttgaaaggaactgcgctcgatgctgagtggagatgcaggttgaaaaatccccaggatcgtcgcggtcgactaaggcacagcctaactgctaaggtgagggattggtgagcaggcacattggcgcgatggactcggtacgtaccgaactctacgaaccgatggatggatgtatctgtacaacactgaggcacagggatcgaggcccgatttatggggcccgagactgtctctgggttcaaatcttggtctatcgcaaactaacaattgaacataattgaacatggccggctttgtattaatcaacatcttatcgggggacaatactgcacaccggcgacacaatcgaggagctgattcatgcccaggtatgcttcatattgaatgcaggtgagaatacttcgggattgcgctgcatggacagagccgatcaatctccgatcaacggatcacagccattctcattcacatgcaagacatgtcacccggagcaggcgttactcagaatgtcttcaccatatcttggaagtcgactcacttcgagttgactcaaaatgaatggccatatatttttaacgaatgatggtgattcacaaacttgagcttgactcccccagtcctgatgcaacagacaagtaggtcctcgtcctgcttactccgactacccatccagggcagatgaatcagtagtaaagatgcacatccaactccagcacaactgccaggcgggtaagcaagcaacatgggcagtgccattggaagcagtaggcatggccagtggatctggtctgcgcctgaggctgcaagaatgtggggtaagcgaccctccgatcaacctccgacgtttttcccacaagtcattctttgaaggcctcgctccgattctgactatttatctagtcacaaggttgctctcttgatccattgtcttggatctcagggcagcttcctgtgctccttcttatcttgccccttcagctccaggaccccttggttctcgctgactcaattgcaagatgatgtctctccgaccaatggctggggcctctcgatgggctgccgcagcccgtaccgccgcctctctcaacggcatgagacactcatccagcagctcgacctcggccatcgcctacaaggctttgcgacgtcgttcggcccccctccccgtctccaacactcccccatcctggtccgttcaggctgctgtctccaacatcctctacgagacaccgacaccatcggctgagcccccgaagcgacatatcctcaattgccttgtccagaacgaacctggtgtgctgtcccgcctctccggcatcattgctgcccgtggcttcaacattgagtcgcttgtggtctgcaacaccgaggtgaaggacctgtcccgcatgaccatcgtccttaacggccacgatggcgtcgttgaacaggcccgccgccaactcgaggatctcgtccccgtctgggctgtcttggactacacacatgccgccctcgtccagcgtgagcttctcctcgccaagatcaatattctaggccccgagtacttcgaggagctcctcgagcaccacagggagatgactgctggcgcacccgttgagggcgaagagccccaggctcagtctttggaggaactcgccaaggatttccaccccagcaagctcgctgctagtgaagccttgagacacaagcatgagcatctcaagaccattacctacttcacccatcagttcggaggcaaggttcttgatattagcaacacaagctgcattgtcgaagtgtaagtggccccccgaagtaaaaaatttgcttgatatacaatactaacctcccacacagttccgcgaagcagaccaggattgattcattcctgaagctcatcgcacctttcggtatcctcgaatctgctcggactgggctgatggccctgccaagatcccccttgcacggccccaacgaggagccaattgtcaaggaagccgacgacgttgtcgacgccagccagcttcctcctggttagatgttgtaataagcgttgcgtgatgggttcggggttagcttgtttatatttacaaccctaaatggaactaaaaattgtgatattaaatcatctcctttttgcaccttgtcatactgaacttttttacacttgtagctccaatgtaactaccgttactcccaagccatatcatccttcaaagtcggcccttgttgacaacgaatccttccagggcagctagaatcacatcagcaataggttccatataacggtggaccagagacattgactcacagacagcagcccacaggcgattctccgcctcggggaacaccaaagatcgagggctgtagaagacctcgtctgctacctcctcggggtgcctcggcaggcagtgcatgaatttccagccctccttggcaccaccccgcttcgcgagctcgttggtgatctggtacccggcgaaggcttccaggcgcttcttcttttcgctctcctgccccatggagatccatgtgtcagtgacgaggatgtcagcattcttgatagcctcctctggcacattggtctccaaaagctttccgggcgaggacacgccctgggcagccgagttgatgagatctttcatactttgcgggatgccgtagccgttgggtgaagcgacggaaatatcgactcccatcttgacacaaccaatcgcaaggtcaaagaggacgttgttggagtctccaatccaggcaaccttgagaccctcaaggcctaggctggaggtgccgctttgggatgctgggaaagcttcgtggatggtaaggaagtcagcgatagtctggagaggatggaagtcgtccgacagagcgttgatgactgggacgctggagtgtttagccagattggcgacatcggaatgaggtccaacacgggcgaccatgcaagaggtcatggaagaaataactactgaagtgtcatatagcgactcgttgacctgaaatggagattagcttctgcatcaggcaaattgaatggtcataagcttataggcttactccaagctggatgtcatccttgcccaaaaacatgggattgccacccatcagggtcacagcagcttctgtagagacacgggttcgagtgctcctcttgctgaacatcatggccaccgtcttgttggcaaggccagtggtaagggagagtggtggctgagtgctcttgacggcagtctttcgtgctgcagcgttacgcaccaacgaagtgaattcagcaggagacacatcggcaattgacattagatgccttgggcctgaggattgagaataattccttttggggacgcctttgcaggctacctgggcagctcggaaaacgttcgacctcatcttgagagccggatgattgtatgatatgccttgaaaatttcacaattgaacgcagtgctgcaatttcaattgaagaagaaaaggcaatccagatatccaaaaagttaaggacctgcccggatgtggagaggtcggaattatcagtatttgttgagtcacgaagccagcaagctgaagccgatatcgagtaacagcggtcacaaatcttttagtggaggaaggccacttgtgtgatgtacaggtacttgcaagtcacttgtaccttgtaccacccactcaagctgaagttctccggggatgcaggggagtacctagcttagccaatcagaatcggccggcaatcagggtcaaagccactcgcacgctggtcgcgtatcgtcatcatcacttgtgccttgcaacttgcgcccaccttgtttcgcctcaccatcttcctagaaacacaccacgggcggctgggagtcatcttgaactcactctcttccaaactcgcctatccagccgcaacactttcattttctccctgcgtctagttccatgtctacgccaaactaagataagaagctatccgcttgcgtccgccctgcctccggacccgccatcatggcttccgacgagagatcccctcttctttcatctgagaaccatcagcaagtggactcaaatgcaaccgaatcaacccctctccttggtgggcagcaagaaacctccggagatggacagcaaaccgagccctccacgacatctccaaacaagaaggctatttcgagctccaagcagtcgctcccatggccaagcatcatcgcctcgatcatcctagccatcctagtcgtggcagtcctgatcggtaggttcgtcgtgcctggtgccgtccagcagtacgccgagcaagctgcagttgtagagcctacaagcctttccgtggagtccatcacctccgacggtgtcagggcccgtatccaggccaatttcagactggatggttccaaagtaggcgatgacaacgctcgacgtatcggcaggcttgccactggtgttatgcgaaaactcgaaacagaggagacaaccctgagtgttttcttgcctcactacaacaactcgctgcttggaagggcggttgtacccgctcttaccatagatattgtggatggtcataccacggcgttggattttgtgacggacctgagccctggtgatgcggagaatatcagaaaaatcgccaacgactggctgacgggcaagctggaatggctgaagctcactggcgctgccgatatcaccgtcaaatctggttttatcccactcggaacacacagtgttgtcgaaaccttggtttttgaaggtcaatccctctataattctttcgcttccctgtactttggagagaagatgattttgcaatgatttcacttgtctgcttttttggcgagaacatttactgatgtcctcgcagctaataagattccgagtattcccgagtataagattgagcgtctcaatttccatgatgtccctctaggccctggcggcaggaaggcagttggtgccaacgtctccatcgtcgtgcacaacgattatcctattgccgcagatgtaccaccacttagtttcgatattctcgtggcgaattgtgacgcatccgagccttatattgaggtagcggaagcggccacaagtctcatcgaggtgcggccagatgccgacgtaactgcaaatgccctgggcgtcatcggtcagattcccgactctctggtgcgaaactgtcctcggagcaactcgtctcccctggacatgttcatgaaacactatttgaatggcgaagacgccgaggtcttcgttcgaggaaagaccattgttgattctgatttacctgcctggatatcggatctcttgaagaatctggtcgtgccgattgaccttcccggccgctctttcggcaatattatccgaaacttttctgctacggatgttgacttcaagttgcccagcccattcgctgacccaaatgaccctgagtcatctcccaaagtgtccggcaatatcgaggtgttcgctcttctccctgaagagctgagtctggatattgcggttgacgctcttcggtctgatgccgatcttttcttcgaagggaagaaacttggtgagctgaatttaagacagtggcaggaagccaagtccactagagtcgaggatggtggcgatgaactgctgaaagtcacagcacaaatcaaagacgtgcctctcaagatcactgacgacgccgtgttctcggatgttcttcaaaagatgcttttcggcggaagggacatcatacttgatgtcgaggccgccgttgatgccaaagtgggcactgtgcttggaagtttgacggtgaagggagtcccagctcaggggcagattccagtaaagcgtccgtcctcactaacgaaataacctgtgacgtcggccgacaatctgtacttgaacaagtattcctatcgtcgtctcacaggccagtggcagatagggactaacagctctttcaggtctccctacagacactttaaacgccctggaaccccaagtagatgagctacggatcctcaatacatccagcactggggtctatatgcaagcgagcgtcaacttttcgaatcctacaccatacacagcctccattccctacttctctgcccgcatcttaaacaacggcaaagtcatcggagaagctgtggcgaaggacatatctttgaaactagggaacaatactggaaatatcatccatgcaacttgggatcctctcagctacgggggtcctgaatctcatgaaaacgctcgacgcctactatctgattatctatctggcgagaataccacattggaagtggcaacccatagggatagtttcccggggttgcccgaactaggcatcgcattctccaaactcaactttaccgtccctacgccgcgcttgaaacttccaggagatgatgacgaaatcgaagatggagcgtcccgtctgggattcatccgggacgcgaccttccatctattctcgtccacagcctcattcactcttgcatcgcctctacatgcgaacactgttcacttggagcacataaacgctacagctttttacaatcacacagaaccagttggccagattataaacgataaaccttttcccataccaccgggtctttcccaaactccccgcctccccgtcaattggtcacccgatagcatcggctatgacaaactcagggatgtggtggggggtcagctcaagcttgacgccatcgcctatgtaacactgaggatcgggaattgggttgagcaggtacgatacgtcggtcatgggcttggtgccaaggtttccttatagaaatttgtttaaattcggcgttatgggacggagtaaggactggcatggtgttttcccttatatagagcacacatacaagaatttgtacatttgtctacagaccatgtgggggtatattgtatacaaagaatacatcatttcatttcatatgaagaagttgatgaactgaacggcttttccaaacacgaacacggttgaggacgaaggcgagggcttgaacgtggacgtgaatgacaggacggcctcgcagctatcgataggggagtgccaggccgtcttcacaacaaacatatacgacgtcgtctaagcgcgtagcatgtgcgtgctgtgcgccgatgtggctacctaggcggcggtccttaggggggagccctctaggcagcgagcttcgtccgctgtgcggtagcaacgtcgacacggtcgccgggccgtcaccagggacgagctgctgctgccacggcggtagcagacgtcaacagctgcctgtgcgagcgtcatctgagggcgaagtgaattctgccggccctgaccgcggctacaaaaccaaacaccccacacaacgcgtaaacactcgaacccaaacataaacaacaacaaaaaaggcacaataggctggacgacgcccagcatgcctaactgggcgactagtatagccataagggctaaacttgaaggtgaggcggtgccgccgtgccagctacagacgaccgacaggtcggatgagaagagtgagtgggggaaggacaggtcctgtccagctgctcacgtcgcaagacgggatacccatgactacgggcttgcggaatggtatttcgtgaccacgtggggtgatccgaagatgcggccgttgagggaatgggcgcatccgaaggccaaggagtatctggtcctggagcccaggcacctcaggtgggaggagtattgggaatccatcaggatggcgaggggaggtaagttcagggaagacctggtcatgcggatccccaactatgatagacctgttccggtcggtacctcggtcgactggaagatgagcatggcggatctcgccgttcatcacactgactcggaacagtcacggtgccgggcgcggacaccgttggtggtggtgtgcacgagggcagagtacaaagccctggtcgagcagggctgggaggccgtggagaagaggtataagaaggaatcagcacgcagcagggctgccgagttggaggaggtggctatgtctgacatagctgccgaggtggaggtgactgagacgcagcaggagctgtcgaaagagatggacgtggacgaggcagcctacccgccaggtgaggcggggatgctggacccgttggcagagatggacgtagacgaggcagtgtgcctgccagacgtagacatgacggatggaaccgggcaggttcctcctgaaggcaccacggacgagatcgccggaggacccggtgaccccgtcgtggtagccaaggatgagggccaggcatggcgcatagacatcactctccgagtcgaggagggctgtagccagaccgacctggcggttgatgtgaaggtcggctgtgaaggtgtgtcacctggaaggtgtcatgatggatactagtatagtactcacacagtagcgttcccagggagatacctggttagaagacaatgcaacaagtacattgatgccaatccatgaagtgtgacagtgtgtatcatcgaatatcaatgaaacccaatttgaatggcttaccttccaccataacctgtacctttacattagggcagacttgattacacgagaggtgtacgctgcaactctaatatagcttactctacgccagttttgatgaccattcaagtctcggaagcatggggcaggcaaatacacttgatcgtcgacgtgatgatcacattgtacaatacgaaataaggagttgtctcatcgaacaggaaaggggcacattttaaagggctcgttgcctcaagggaaaaacctcaaaccgctcaaggtggtcacggtacgaaagggttgaggaaggcaaaaatacagcgtcaagaaaaaaagaatgacaagagagaagttgtacaaaccggggtatctgaaccaccaggaatcgttgttagcagggattaaagctaataaggatggtaaaatgaagggaaatgcacctttttcacaatgcgttgcccaaaaaccgcaaatcctaaactccaagtaaatttactgttgctatccgagtcgcactcctgcttctttgcgcttcttgagctgttgggatgtggccatgctcattcctgcgtgttgcgtagcgtcgaacatgctctgagcttcacgtcgtttctcatctgcaatcttcttcagtcgcttctccgtcttctccttgccgctacccttgccgtggaactcgtgactgagttgcttgaaagcctccttctgattaagctcacggccatgctcgtctgtgtatttgagctggaaggtgggcttgtaagtcgattggaaaaggtccaccatcttctttgcctgttggtgatctcgtcgctggttctggtgtcgtgcataatcctccctctctctggttgacatcttgtccattttggcgtgatgtctgtcgtactcacgttgtctcaaggcttgctcctcaaagttccgttccagggctgcctttccgtggagaaattcttgacgttgacgttcaagcttgatttgatcctctcctctggcttcttcaatcaggccacgttcacggaggagtgaaagggcagcacccattccgtcgctaatgtgcttctcttccccaatcccggtaccatcctcctgttcttccacgggttcaggctctgggatatcgaattgtaccgacttgtcatgagcatcctccatctcttgatcttcagtagcttcgggcgttttggtggcctgctttcgcctcttctgtctcctctcttccgcttcctcatcgtcctcatgcttggtgagcccagaaacaaactcggaaattgcgccgatgaccattcctgtcccattttgggcatcatcctgcagcgaatcgtcctcctgttccttcagctgcttagcaagatcttcaaatcgagtcttcttgcgcttcttcagtgcgagctttctttgagctgccagagatgcctggaggtcttcatcgtcgtctattatgtcgatctcttgcttccttttcttgccggttgtgggtgcgcttccgtctatatccatagaatcattctcggcgactacaggctccttgaataatacatcatcctcgttgtcaatatgtttctgcctcgatttgttcttcttcttctttggcttcttgaccttgatttccgacggtgcaaggtaatccgaggatataggcccgtcgccaacaatatcatccagactaacactttgcttgccaagggttgttggtgctggctggtccaggatatcagcaatatctcctatcattccattttctccaagagtgaaggatttcccttgctttcccataatttcctcgtcgtattgtgcaaggatgccagtatcaccatcttcatcgtcattcgggttatatccgggtcgcttcttcttcagatctagccgttctgagagtttctcctggtcccgaagatcgatgttctccagctggtcaccctcttcctcgttctcttcaattgtggtatccttcaaggtaaggatttgatccccaccatccaggagcgtcgatgtatcgtgggcaatcttgatccctgcaagatcctttgatgtgtattgcactgctgctgcggcttcggcctcggcagccgcaagttcctcttcaattttccgcgccttgtcgatcttcttctgtcgcttcttctgtcccaacaaccaagatttcgcgtcctggtcgcctttgtcgtcttcctcgcccaagcctctaccttccaacttggccagtcgctgagcattctctcgtgccttttttacggcggcgttcctctcttcgcgcttcttcttcgcggcctctgcctccatgaccttattgtagttgtcgtaggattgcgcctggcgcgattcgacggtgctaggagcatcatcatccccgtccttggtctccgtcgaagctggtgcatctgctcccgggaccggcaggggcttcaggcccagcgagacccggatgcggttcgtctcctcgattgttgcggcgtccatcgcgttgaccctgtagttgatagaatgacgggcaaattgcgctgtcgtctatgcagataagctatcggatccaggcaacagagaagacccacacccaacctcgcagaatcacgtgcaggacccacccggagcctatacaactttctttcttcgcaggcaaatttttgttttgttttcttcttctctacaaaccggatctgtgtgcagcggtcctctgctttacgtcagggtcgactgctgtacagctcgataacttatagaatcaccaacctgctatggtgtccatcttgtcgacaggtccaatattgactgatcttccgattgcctagttcgtcatcttctgatggcttgagctttgcggtcggctgctcgaggcgctatattccacccctcttttccaaggctctgtgctggtgaggttgaggaaaaccatagttttgcctacatcccctgtttttgacatgcaatttttcatggtgtccaaataaacagcatcacgtcgccggtttaacaaaacccaggcttcaggtgcacgtagatctccatcaaatatgcacgctatctgctagtggccgacacgttctggagtcacaagtaacatgtttcaccacgaatgggcttcagccgcaaattcgatagaagcatactgatctcatgtgaggctgttgatttcatgccaagcgctgagtgttgagtcttcatttgctaggcctccaagatttgtaccatgagcctggtaaacgaaatgaaatggcactcatcagaaagtaaaattttgaacccatgcacgcttgttacaggagcattgcaacgaggagtggattcattgtctaataagctggtttccaactccctgggttgccaggcatatatttcataggtatatcatgatgtcgcaacagaagaaaagaaccaatgtcaactcccgtataaatataaaaatgcgtccttccctcatgccatacagacatcgtcccgtgcttacctcacgcaggatcagcccattagttgaaacctaagcaaactcgtcatcaggttcctcaatcgaatttttcactcgaaccaaaagagtcgtcttccagttatccagtttgttgatttggtcaaactggaataacttgtctgtgaactgatcttggctcttcgcctccacagcgtcaaggaggtccttgagaagcataaactccctctgctgcgtgaacgacgggtccatttcggcgtatcgctcaagggcttgttgagcggcgaccaaatcctttgttgcgaggtggcaaatccctgccttcaggaagtagtccttcacgctgtacttcatcaggttgttgttgatggattgctgtgcaaccttctcgtagttctcgatggccttgtagtaatcctcttcacgggcagccaagtctgccagcttgagccagagcttgtttgccaggctgaaagattattagcaccctaacaaattctagatttccagtcgttggagctttgcgcttcacacttacgcatttgcgttgtctccctcgaaccaagttgctgctgcttcgtaagcagcaagcgcactcttggcatccccaagctcctcgtacatttcggcgacggtctccttgtgggtggcagcacggcggaagttgcccttggcgcagtaacggtcgatagccttgttcaggcaacggatggcggcttgcgggtcgtctttgcgataggccttgaaagcgtcggcgtagacatttgctgcgtcgtcgggctcgttcaggttgttgatgaaaacctcggcggcctgctcgaatgcttttccggcctcgatacctatcggttcaattctcgtcagccatacatcgcctcgtcataacaaaactcttgctggggctcccggccgatgtgggtgaggggaaggaagcatgagctgtgtcccggcatcagcttactttggctctgcattctgaaggcattcgcggcttcgacgaacgcatctgcggcattttggtacttctcctcgcgaccaccgaaaaagctgaagcccttgccggcatcttgcagctgcttctgggcctgtgagataagaggtcagctacggctcttgtagcgggggaggggcagcgaggttttggacagcggttgaccttttggagaagggcacgaggatcttgcgacatgtttgcggctcgtcgatattaggtgtagaggcaatggatttgttgttgacagctcgccacgttgttagttgctagcgattacttgaatcctatcagacggggttggctggccagaatgtcaatcagctgtaactgcaggctgccgccaatagggtatgacgccagcacgttgcgccacactgctcaaggctgtggcaatgtggggctttctcacagcttcatgtcgttcacgaagagccatctatatttagcagtgtatttactatgataatatctcgtgggctcctgttgcgaacaatatttcctacgccaaacaacttccatgctcggcctggtttgttcttgtattcaattacggatcttttcttaggaactgcaggcacacttactgaaggtagtgttaagaaactcattgattagaacaagctctgaatatcattatatgaaacaacgaatgacagaaatacttagcaaacccccaatccccagaaaacttccaaccaaatcaaatgaaaagacacgctttgctatgaaaagctctcctggtgtggccgagatattgtctagaaggtggagatgattgcgtatagggtagggtaacatacctgtagaatcaagtttccatatcctcaaatgaggcgcaaactagaactctcagcagcactgcgatcaaaaagacctgaattacgccaaccaagcaccacaatgtctatatgtgcaccctgtcgagccgccatacggcaggcattcagaaaccaaatcatctcaaagcgcgcctcatcgaccaatccaccttcaaccgcacacaccatcctctccaagccctcatggtcagtccgctcacaccttggctcggccgacagcccgagcgagaagatctcgccggcacaactcaaccacctcctccgcctggccgccctgcccccgcccaggaacaaggccgaagaggattccatgatcgagacgctacagagccagctccggttcgtgcgtgcggtgcaacaagtggacaccacgggagtcgaaccgctacgggccatccgcgacgagacacagcagggcacgcgggagaatacagtatccctggatactttaaagacgctactcgatgaagaggcattagttggacattacaagcggtctcgtagggttagaaccaagctggacccagaggccgagaattgggatgcactgagcacggcatctaagaaggccggtcgattcttcgtcgtccagagtaataagaagaacgcggacgaaggatccggataatggggatattcgcagggtaggtcctgcaagtacaccacccagttcaccacagcaagatacccagatcgaaggtccaaatattaatccagccattgctaggtcaatggtaatgaataccccaaaaacacgccaaccaaaattttcagccatgctgcctcttcgctctatagtgccacgatgaaggcttacaaccaaaaccaaagtaatttgttttgtttccccctatccgccatgaaacgccagtatattattgtatcgtccatttcgcgtaatatggtatactacaacaccccctacccgagcgaaatacagctagggcttgctgccacttggttcacctgcctttggcttgggtttaggtaccttctcataagcgtttggactcggcgctctcttggatccctttccatcccgctttcctttcctaccgcaatggcgatggtcgtggtcgtgctgcttgcctttcccgcggtgatctgcgtccggctcgtcagaggaggagtcggaatcggagtcggatgacgattcgtcgctggactcgtcgacagccttcggcttatgatagatgcagcagactgtatccggcgtcagccatgactagttcccggtggcggaagagaggagaccaacctttggagcttttgcgccccagaccttcgttatctactacatcctcggcccattgtactgatcgccccgtggaagttccgtcaccgcgcaaacgtagtattctggtagggttctgggtctgagtttgaggtgtcgttgtggaggtttgtgaaggtgcggatgtcgaaggagccgctcgttgttgcgggagagacatggcggggcggtctatccttgttcctcgttgattccgtcgtggtcgtgttcgtctagctgaggggcgtgtattaagatggactaattaatcgctataaaacggaaaagcgagagtatctatggcgaaaaaggttgtttgggcgacttatttgtcgtattaagttccatcgataattttggaggggcaaaaaacaatgagtccgcggcaggtgacgctttgtcatgcaatcatcggcatagtgggcggtcagtgtcggcaacccccaatcatccctgatgtccttccatgtactgcaagtttagcagtatagatggtgaattatcttgaaagcttctatctattgattatatttctctatttagaaagtagggatgtatatgctttgaaaattcgaagtcgatcaacgccagcgctatgagtgatgtcatcagcttttgtacatattaaatccgtgtttttacatgagcatcaacttcattcagcctactcgtatgctctcaagtctgttttttctttcttcttctgtcccttcatacttcttcgaggacggcccctcttatgctttgccttcaataacggcttgttgttgagccatccctcaattggcttccttgatcccacaaagcgtccctcaggggtaaagacatcgaccacaggccaagggggctcatacagttcccgctctggctctggctccggctccgacatgagattagttttgggcttttgcacccttggaggttcactgcctgagccacgccgttgttccatcatccgttcgaacggatcatcagatggattttgccagctactcgaagcctcctgctttgcgggttcttgaatcggccgagaggttgtgaagccgaggttcttcggtggctcgagcgccttggcatgcatctgagctacgacctcgacatatcccacgccctcaataagaatatccagggagaggacgcggaaggggagttgttccaccttcaacccaactgcatccttgtttgtcaaggggccggctcttcttctcgtcacatcatagcgcaatttgaagcttccagcatgctgcattttctcgcccacacctggaagcgttatattctccactccaggagatactctggtctggttttgaaattccaccgctttctcattgttggtcagatgctcctttagtggcgtaaagttgtacattaagaaggtcaagccaggtgttcggggcgtgatgcgaatgagcccgccaccaaggagcagggagttgtcaggtttgacattcacctgctctggaacaatgcgactcttcatgatcaacccttgacgatgctctggcttcacaaacagctccaggtcaccgcgggcaagacctggaagatcaaccaactctcccttcccgttgccaaagggtatccggattggagatgcagtggtgccggggagcgatgacaccatgggcatctcagggtactgcttgagaggctgagctggagggaggagcttggcgacattcaagttcttgtaacgatcctcctcctcatcttcaaagatctcttggtctttgggcgcatctcggggatacatcgacacaaccgtatctctgagggccgcctgatcgactactctgcctttcgggtacacggcctcgaaaagctgacttttgccgacgttgactttgccgaccatccagttggcccctccgcgggaccatatatcttcccttactttcgttgtccaccatccccgtttcgcgctgacacaactgacatttccgagacggattcggtggcctactctaccgagagcctctcgcagcacctctcggagatatggcatgttcctatcgacattttccttcgttggtccaaggaggtctccacgtgtgatgatgaagcttaggtcgattttgcgatctctgatgtacttggcagaccgcgaccgacggtttcgggttcgtaaggggatatcgccgaggaggacattgaggcgagggataagagacatggggaaatcagcggcatctatcacgtggtagatgtggttgtatttgaatggcgactcctcgatcgtctcgcgcaaagagtcgacggtggggtggaacatgggcactgccgccgcagcacctgaacttccatgatgcgtgaggtcatgacagcgatcacagacgggctgcttgtcattggttactagaacattcattaacgatgacccggatatttcctgtgaagtgcgcgtaaatacctggcttcgtaggttgcacctcgtccgacacgagcgagctcctgtctaagcccagagcctcaagttggtcgctgcctagtgactttagcgcctcagatataatcaggtcttcttccgtttccgagatctctctctcttgatccttcttcggatgcaaccagttttgtacccgtttgctcgtgagatcaaagaatcctagctctttgggatcacctgtttgggagaacgctccacaaccactgcaattgatcggcagtctcctattgagctttcctggatcttggggacccagagatcctgaatctccagacacatgttgcgaagcaattgcatgattttgtcgggtttggcatggggaggtggctaaggccagaggtctgatctttgcctccaatgaggtgggagaaagtcttgaggtgacagggtatgaacagagagctctggcactcgacggtagagatctaccgctgagacttcgattcaagcatcgcgctgctacagttcgatgcatctctcgctggtactattcagaccagggcgtatgtgtgtaagtcgccgtgtgatagtcaactgtccttcattgagatggtcaactttttttagccacttatcttatcgggcctgtcgcgtgtgtcattcatcaaacccgcgtaaagttgttcagctttcagtattgtaggccaaaatccggccctttgctggccaaaatctaatagtatagattattgagttatatgaatcaggaataaaagactctttcaaggcaagatatataattgattatatgatggcttttttaacagtcaccagctcgttgattgttgaaagacaaactcgcaacagccaactttaaggtggggcaatccatttatctacacgtgacgttgaattcgaggcatcaaattctaatgggatacaagccggagctttgcgattgagcatcggggacagccagaccacaaccacagtcacccagaacacacaatattcaccatgaggtctttgggcatccggtggaacaaattgagaagagtaagctcgaccccgcactccaattcctgttcaatgctaactctgccctgcacaggctgtatgtcgttgccagtcaaattcctaataggtagagattcttcgttgctcacgattcaacagctcatcgacttgaaatgcggtcccggagccgcgatcctcccgccggaggtcacccgaatacacatggactttgccttcaggctgaataacggccacatgggacccaagtatgtcatttccagacaaacattaggttatggacggaagttaacggtatatcgccctctaggaagttttggaaggaaatcctgcctcgaatcaagtaccacaacccctcggtccccatgatcgtcaaccgtcacaccaacaacgagcggccacccgtcatgaccatctacctgcgcaaacccgacgcttcacccacgtccgacccagcacccgtccagcccgcatcatcatgggctgatctctccaaagccacccctcctgctgcggatgagcgcgttgttaccattgatatgaagaacaagcattcctcgacaatcttggagttcttccttgcagagacgagagctttaactatcgcaccaacgaaggaagagattgaagagatacagtcgttgaaggtcctgaagaaggagtctcaggtatctcgtgctcgtgtcctggccgatagaatggcgaagaagagagaggaagacatgctgaagcgagcgcgagccgcgggaggtttggccgaagcggaataatattttaaaacttgtatgataacttggtgtattgtatggacaagccagactaacggctgtgtattgacgatgtgagcgttgacttgctcgtgtgttcaatgtatgaagaatctacatatgtactttgtatataatgcttgaatctaattctaaggcatctcatccaagtcttatttgatcctagcacgttcgggttttattttgttccaaactcaatcttggggtcatggacatttcgtctgtcatttcctcatatgcagcattactttagccaaaagccctcgctctcatacaccgccctccagaggatggtccggagcgcttccttcgaagggtattttgataaacttaacaaattgaaacatgttcttgcaattgggtaccttccagggtcctcgccaagacatgatagtttgatgggcatcatggatgcccctgtcgcaggtagacggtcgctgcctgtgatgaatgataataatttgcgctggtctttgggagatgcttcttgaaacagctcccaaaaccaactgacgacaggttctgagccatctggctgtttggtttcccagttgccgtacacagcaacagcccgtaatgttgaaatatctagagattcatcagaaccccggataaggagctcaatttcttcaggcctgaagagtgagaaagcatttcccccacaaaccgtatagaaccctcgtttgaacggttcgaattggcgggtaactgacgtttcgagaatatatcggacatacaagtcgacatattctcggcggttagctgttgtgactgccctgctttcgccgccgggacaaagcggcacccgcacagttgtatcgtatctgtcgacatcaatggcgaaatccaagcaaaaagtcgcctctacatcaccatcatagtcaagcagctttttgagaccctgggccaatcgtggtcgatactcgaacaaatcctctagactgggtttcgatgactttcgtgagtatgcaggctggttcatggtatttgctggtgctgctgctagaagctttttgaaaacaaagcctgggagcgctgcgtctaagattgtagagttgtatatcgccaagccgaaaagcgctccgacgagaaaaaatgaatcagaagtctcgaatgaattcgggttgaagtagcagtactgcgaatcttcatcatatatgaacatccctgatattaattagtgtcaatatagccataatgtgatggtatcgacagaagagtaaatacttaccatgatctggattgaagacttctcggataaggagcaagaaccactcttttcgcaagcctccaccatcgataccttcttcccctctgaatgagatcctcagacctttcttgatgtcctcactaccactccctatgacctcactgacggcctggaggctatcgtcaacgagacactctcgccggacgtcaagtgttagatattggctaatggttcttctagtcatgatgctattgaagaatgcatcccgagctttggattccatttgccgccgggcatcatgctctagaatttgcgtttttgcccaaatacttagtaagaacggatactggcaaaaggtgaatttgcctctcctcgactcccacatttcaaaatcggcaatcagatcgatattgtcaatcattgaatgatagaagtcactgttttgcaagtgaccgcgagaatgcccacctccacgactgccaagtatatggttttcatttgaagctgcatcgtcactgcggcgaaaggtgggtacattgtttgctgcgaaccagagagaaagaactcgggcggcagatcgtatttgccaatcttccgaatacattgctttcttagcttgggacttgggttttttcatctcatcatgtaagtacgccccagacctgcctgtctggagttcagggatcaagcctgccgtgacatcaatttttgtttcttgcttcttctcgctttgtcgtatcatcctgtacgaaagaaattcataaatgagatcctttgatcgattgaaccttgaactagtggtacgagtgagccaggttataatctggttgtgacactcatcaggagcgttggatataagcccgacaaggcgtttgataataccagagtggtgtccaaataagggaccagaccgggcttccaccccctcttgatttttaagccctgggcttcttttctcctctgattgtagaagacccgagaataagtcgacgtgagaagaaaacaacggattttccgctatgatgaagagaaaccttaggtccaggacttctgtaattcggccgccgggccgtttcaggaagttttcggtggctttcagtagcactcgctgcaaatggtcctgggcctgtaaaagttccttttcaatatcttgcagggtcgcatcggtcggcgttacgaagttcggttgcttagacaagtcttcgtagacattgaaccaagtctgggcggcattgatgactcctgtataccaagaggctaactcatcccagttgatcaagggggatttttgtaacgcaggcggtggcttggtgtcactccccctttgcgatgctgcttgctttgcggcttcaccctcttcttgagcccccgcccaccatgtcccattctcggcgaaatctcctagcaacagcaacttcgggtctagctcatacacatgggattggacttcaggtttgtttggagctctagactcttggtttgcgatgggctgttgccgtcgtccccatgactcacttcctactctgggggtatgccgggggtggcgagtataaaaagaggcattgatgccgttgaacgagctgaagcaactaaggagatagtcctccacctgtttgaatatccattttggatcatcgcgaggtccccgtaacggttttgatgtttgagctctgggcgcaccattccacgccatgccttggaaagaagatttctccggaaagggtgtagaatgcgatctaacactcgcattgcctctgcgaggagggtttggatggagggttggctcttcatcgaatacatatgtgtagacgccagggggtggacctttcccattttctggagggtttcggatagtacactcgtccagtttactatccgatgtttgcaaactgggttgcggttggccttgtttgggggagagaagctcttggcgcggcttacacagccgcgagctcaagtatcgatgaatactctgtcggatcactttattggaataatctaaggataaatgggccgcttgatagctgttagctcaaggtatgcatagatatagcagcgacacacagacatactgggacggtgcgaggatgtggaagtgcctttgcttgtattccgattagctggtgctgcaccgctaccagactgaatcctcagattcttcagtggagataggtcattgattgtgacgcatatggtgcacttgaagacgttcagctctttgggccacctgacagttgctccgcacgtcatacaggtccccgttgcgaattcccttccattcatcggggtccctctcttctgcgtgtccccatcctgccgaggtgccatactgacagcatgatccttgttgtcctggtgcgttgtagattctgtagcggagcctgccttcttcttcttaaagagcgaagggaatgggttgctcatcgaacgcgagtgagctgctttgcgattcggcgttgggggatggaggtcgtggccggacgagcttgtgtcagcaagcacgccgagtgtcgatacttggtgggctggattgtgacttgacgagcttggtttctgagatggccagggagccattgccgacgcgagtggtcgacagtctcggttggggcaggtgggatcggcggttgatgctggcggcttgcacaactatatcgatggaggtagctactcgaactgtgtttacagacggagatggatccctagctgcacgttctccaatgcaaggacggcgacatcagaccttgccagcatggcaggctctcgcttcgagcgaatggaaaggaagggcattcgtccagcccggttaatgcggctgggtgagatctcgacatagcgtggttgacgggccattgatcaatgtgcgtattggacttctaaacacgagcgagagcggaacccgatccggcgtttaagctccccacttccccctgggatgacacatggctccctacagcagggcatcctcgctgaacatgccaaaaaatccactgtctattacctgaaacgagttttattgcttcttaattcggatttgattttcttgtgctagataactacctggtatgtgtcatgaatgtgtaattagtatccaatctaaaaaaaatccgcatatcggcatcgcacgggattcaaagattatgatgtggtcgagcataatcttatttaaagcaaggtctaaccccacccccgaatataaactggcaggttgataaggcagacaaaaagaaatcaactttccaatacaggccacaatgttttatcgataataaactaatcatttataaataattaagtaattatttgacaatactttttattgtcacataatagcaagtgttattcttggattatggctatgcctagtagttattcgctgtctgggtgtccttacgatccctgtttttatgacagcatgttgtccggccttcctccgggcaacacggacgccaaacttcagctctccggtttatatcttggacgatcctcctttgtgacttcttatactcgagccaaaccatgaacaacaaagtaaaggtggcgacaaacgcattccaaacagtcaccacggtccaaagagagggggtcacgaaatccagggctatctccatctataattgaggttagtattgtagccatgagcgtgagtattagactaactcttactgggagaggtggtcttgggagagatgcccttgctgaaaaagccgatcttggtcggacagacaatcttggtcgaagaaaaaaataagcaaacactggcgctgtaggcagattcgaatgcctctcccaaccatgggatcatttttcggtaggagcctaggtaggtatctaggtaggtactgactaccttacatgtacataaggttggcacggcggagttgaaggggctggcctacctaaggaggtaaatatatcagattgcgaaataaacaacaacattggatcttccgtttgactttgatcaatacctttgtgggtaggtaggtttgcgggggcactgtataagcttctgccaacatctcgtaagtagttagcataagtaactttgagtattgcttctttaacctcacaagtagcgttaacgcgtctcttggtgagaacgaagagaactttccttccgactaacgagaccggtgtggaaggcaattgaaatcatgatgtcgtcagcatcttaaccatggtcgagggtgctgagcctagagtgggcagaatcacgcatcttcagcaagtctacatgtaatagctacataagagtaacgactagtgattcaagtactacatatattacaaacgactaattgaaagcacatggaggggttcaccctttagatcccgcacctatgtcatcaaggcggcaaaggtaatgttggtagccacgaaacaacgactttgaggcgtccactgtagcattagcgaataataggtttggcagccacaagatggaatgtttatcgataattgaagggcatgggagcatgtgtagcaccgttcaaaagctgtaggacggtggttaatttgcgagagtttcagacatgccagtaggtttacgagaacgaggcgagactttgaagccctgcgacctcattaccaaggacaaaattgaagagaaagatagagtggaaggcatcctaattccactacccgctgaaagaactagtaggtgatgaaggacaacatcatctttctcctctttactacgtggataaagacttggaactgtcctttttgctatcaattacagctggaaattcaaaatacctaggtaggtaggtactaatgtatcattgcctttggctgtgttcatcacctggtgcctgccctggaacacgatcccgacactcgaccgagcaggcagtttctcaatttgaaatgaggcagcattagatctagatccatgtattcatttataccctcaattcgcgaatgtgttgtgtgtctgcagttgttcggtacctttacgtagcagtcaatctcgcggaggaggcaagggagcccttcaacccaaacatacaatctctgcggcaaagtcaagattggccaattttacacatcagaataaatttttggtgcaataaaaagcagacagaaatatcctattgaattatcaaggtgtggctacatcccgctcattctattgtacttggttgccgcgaactcgacttcgtccaaccatccccgcctcgaagcacaattgttccttctgtttcggcatcccaaagaatttttttcagtggaattcgtagtcgaagaacttgttgggaaggagggtaagaggtacgtacttttcatcacctatcgcgaacgtctggcacctgcctcgccatccattgcagtacatcattgggcggggcaccttcctcgacccgaagacaacagcgtgggatttttagtaagtgcgcgtcatatggcctaattgtcgagaaagagtgacagtatgtcggtatgtaccttgaagaataaaacgggctcgcttcgatgtccatcttctctcttcgcttctccgggcaatatacagtcggcacgaccctccaagcaacagacagtcggtacaaccccccaagcaacagacagtcgacacaaccctccaagcaacagacaatcggcccaatggccagagacgtaagtagtgttccaaatgagctcaattgaatagtctagtctaacaaattgatttaggagagaacaatttcgatcctggcggacttggccgcaagtttgcggcgggccaatggaagagacgtcagtagtgatccaaattcttaattgaactgtttagtctaacaaactgatttagaaccagaccataaagttcgtcgctgacctggccgcaaggttgcggcaggcgactggggcttcagcccctcctggcggtcgtaaccgccaccaccggccaaagtgctggaatgtaagtatatgcttgtctgccatgattattatcagttgatcatttactgacatatgcagtgcaaaaaactcggtcatgtgcgcgccgagtgtcgggcacccccccgcgccgccgccgccgccaaggatgccgcccccacccctgggccgccccctccaccctctgaggccgccgccgccgaggctgccctcccggccgccaaaccaagtcaatagtagatagtttttgtttcgatttaatttaatgtttgttggtcttgcttcaatatcccgcctcatcccgtaattgaaaatccatgctgttgtagaaaatctttggcccactactgaaggaaaggtgcatgagtatgcagagccttagagaacaaccaattctacatttaatttcagtacagttataggcttcgacaccgtctaggatcaaagaataactaacgatgctaccggctgatggtattgacgtcctcatttatgggcgtttctctgtgatgtttgtcacatctccgcgcccccttacccacgaaacaagaatgcaacaatacatctattggctaacctcttaaagtgatagcaactctaagagatcgaggggtgaactgactgatggcttcatctggaaatggtctgctttataaatggatattttgttagagcgtgaatcgatctatacacattcatgtagaaggattcaataccctactcatttagacttttgaaaacctctctctacttaaattgcttgcccttctgctgctagccatgcatcctctggccgttgtgatgctgcctggtgctgttccgatatattattttatcatcctattattgacaagcctggtaatacgacaagcttatgttcgttgttaggcaggagtgtcacacacatggccgataacttaaggcaacttacgccttgttggtcgtctggacgcttctgcttgttcccagttcggtctcgctgtggacttggcccgtctttatgacgtagataatgagtgtctgagacccttgaagtcgaaactttccagatctagcgttcgctagatcaactcggtgcctctctattatgatcctcgcctttcccagtgaaacagaatactcccctctgcgacttgtctatccattctacggtgtctgtagcggccccggtgtcagctgtggccacgagtttagaccagaagaacgatagctggagaccggacttagctgtctgctagggattgagatgagaggtcgttacgggcttaacctctctaccttgtgtaagaaccagccgaacgctataagcttggcttggccgttttctagttatgcgttaagctaatagagagccgacatagttgtctactgattgatgaatgatcgctgtgaatcctagtccaagaacaagcgactgatatttagctggtctcgctgttatctattggtacctgtagaggcagtcaattcgtaaggagccaactcagctgtctactatcaagacgagcgaccgctacggacctgatctagtactctctatctgctgttgagaccagcgatcgctgcagccttgacccaactgtctggctttctgtgcagtaataaatcagtatgaccacattgatcctgggcaatgagttaggagctaaggtatgttgattttgaggttcaatgctgccattaggttgcaatgagcgtttgaaatatgaaggtttgaaggtttgaagcaactcaaggttttggcattttggcagatctatatgacggacgttttctagcgccacaatctcgaacagacggggctgtcgagctgtccgaacatagttttcaactaacactgccgatcagactacttcactcagatgtagtagatgcgagctgtgatgttctttatgcttgagactcttggaatcattaataggcagctgatcgacagtgacagttgggaatagttctcatttcgggtctgcttgacaattaacagaacgaggtttacattaatagcttaaattcgaaattcctcgcgtggggagcttgacgaattacagattccaacatcccaagcgtacttcaccagattatggcaagaaataggagcacatgtgaacgtcgtcaccaatatcacatatgaaccgcattgacaattcgtagagagtaaacattgaccctgatgcaaatcattccgaggattctaacctccaaactcccacggtgaatcccacgtagccgatcaatccacccaaaccgactcatggtcaaccttccctccatttttagattacatgccgattccgttcgccatgcatctcaagagtgacgtctttttatcatgctggagttgtttaggaagggggggcagcgccacggccacggccgaaaccaccacggctgtcaaattgtcagtattagagctctcccaagtcaatttcaaggatagaatggtgtgcgctcacaattgaggagcgtactctccgggagcaccaccctccttgccctcgccagcatcgcgtcttcggtatccgccctcacggtcgccacggtcaccgccacgtccacggccgaatggccgtctctcgcgctcaccctcgccgagcatgccacggggaggagcatgcgatcgctgctgcttgatgtgggtagcaggaacgatctcagcagggaggtgaagccattcgcggaggtagtccagaccctcgggggtcagggtgtagtagtaccactgccaggagaactgggtcttgacatagccgcgggagttgagggactggagagccttgataacgaagaggttcttggtgtcgagatcggggtgcttggggaggttgaagtccttgggggccacgagaacaccctcacggaagaggtactggcggaaacgttagcaatcgatcaatcgatttagaatgctcccacgggaatatacctcgtggatcttcttgcggtcggccttgggaatcaacatcgtggcggcagttttgctttctggtcgatgctaagaagtggacgattgtacgttacgggacagcgaaagtgcctggtctcaaattggattttcttgtgggcggaaaccctacctgaaattcccacctcgataggtggggtgccaatcgtgtgggctgtggctcagctcacgtgatgataagatggataaggggcagaggaaaataattgtggcgcaggcatcctcgggtcggcgtggcaagtaaagtggttggcgcgagtggacccccatcatttattagcatctctacgcctccgacccatcaacgctgtttgagtaggacagtcaacatcgagatactatcaacattcatcatggctccgtcaaatatcaacgttttagtcaccacttttggaggtctgggcctgcctccgactctatcgcttccgctcccacctacaaccacagttacgacgctgcgagagcaactggacgagcgcctacctgtcacaaactctcgcttcatcttgactacgatctcgaacaaacagttgccggaattttcagatgctgcagtcgccggatatcttcgccatggcgacgacgattttttgtcactacgcttgagtgttcccctgttcggtggaaagggaggtttcggatcgcaacttcgcgctgccggtggtcgaatgtcatcaaggaagaagaacaaccagaacgacaatggatcaagccgtaacctggatggacgaagattgcgcactgtcaccgaggccaaggccttggcggaatacctggctatcaagccagaaatggaaaagaaagaaaaagagaagcgcagggaaagatgggaacaaattgttgagatgtcagagcgaagggaggctgaaattaagtcagggagcaaagcccgcctggacggacaatgggttgaggacaaggaagagtgcaacgagaggactcgggatgctgttctcaccgccatgaagtcaggaaactaccaggacaacctcctttccacatcacagggctccgtgtcctcgaatcaaagtatcgaaaaaggcgattccgaggatgatgatgaagccaagtcaaaggaatcaaccccggtatccgagcctgagaaagtcgacaagggtaaagggaaagccagggccttttttggctttgacgaagaggatgagtttatgagctccgatgagtctgatgaggagtaaatggctagcattatttatgtgttttatgtatgattcggcatggcgcattgtgtttccccgcctgcacgtttaataggtggtggtgatttggttgattgaccaccggggttctaagcagctattgcaagcacttgattggagcataaaattatgacgacgaaacagcttttgacattcatatgacccaattccattaacttcgtgttgaattctttgaagcaatgagcttggacaaggtttgagcatttgttatcttttcatgggcctagagccaattaaaacctggtgacgatccgtattttccctcgtaaatcatacgagtcggaaggaacaggatgacgaaataaaacttggaccacttcaccgttacaaagcactaacaatatacataggccagggaggggcgcagggatggatatcaaccaagccaaaatgaattggtattctagttcacatgtggtacaatggaatcgtccatcgcagttctaatcgcccttctcaatatacatctcaattggccacaaatgggagctgcttaagcatcgagcttgacggggaagttgcctccctctgttgaagatgtcagtacggagcggattgatgtgtgagcaaaaaaaatagaatgtcatacctcgctgctcgtcccagcgctggtaccaaccagaggggcacagggagcggtaggcgtgccagaactgcgtgcgcatatgttagcggaagtcggagaggacgcgcgagtgagatccggattgaatagtacctggcggcaaggagcgaagtcctcacccttggcgaggatgcacttgtggtaatcgacgtagttttgccagcagtgcttggtctggttttggttggggaaacgggcgtcggtgcctagaattaaaggtcagatatctcgtgtcctcttcgattcgatcgtcgtggttcgagcaactggcaatgcgttgcgctggaaggtcggcttaccggctgtgcgacaaatgttagcctcgggatcacgaaatagaacggttcgacagcgggattaatgcataccagtgacgaacttgaagggcttggtgacaagctcctggccatccgagtcagacatgatgagtgattagtgcaattggcctcttgaaaagtcgggaattgcgttcgcgggctggcggattcgatatggaatagggttgatggagatggtcgtttgacgttgtcggggtcacatcaggtggtctgacagctccagtgagtgcctcaggttttactcagccaataaaggtcaggcacccaccttgaccactgtgggtccccctccccccgtccatgggatcatgatccaatcccagcggacctgttccatacgtcccgacttcaggcgatatttcttactcgaaccaccaactgcaaagaccgtgcaaaatctcccctcaaccgccgtcaacatgagctctgccatcgccgccaacatgttccgcctgacgcctcagctgatgttccgcggaacccccaagatgatgttcagccgagccccccagatgatgttccgccaggctcctcgcatgatgcgccctgtgcccgtgagtgacagctagttcgtgactgtggcctactggtagctgacaagatgcgacatacagaaggaggaccaggctggtacgtccctgcccacggccaattgatcttgcaacccaattggcaattgaccatgcgacaattccgagcgttttactcacccgaagtcaggtcacaccgtttcccagcgcctgcgaaagctcaagaatatccctctggagcttctccccctcggtaattcgatttctccactaccacgattcataccatattctaacgatctgtagccgtcgtcgttgtcttcgccctctttgccgcgacctactctagcatccgcaagttcgtcgttgacaagaacctgcgcctggtccgacaaggagctgccggccgggaggaacactcctctgatgagaagcatcactaggcccgccagatggatgggaacttccctaatcagcccgttcgttagaaggaccagtcccttatgtatatgagagtagtgggtgcagaagaacgaagagacctttgcttgatcgtctttcaatttcatttgtgccctgtataatcaagtaccatctgttaaacccccccagtaaacgccgtcgctatggtaaataaataagatcaattgatgcaaattccccaggctgcccactactcggctttgggccctgccacatccaaaccctccagtccttgcatgggatcagggcccgaggcattcccattcgcttcaggagcctcaccccgctcgtcaatagaattcttagcaagccagccctcctgtagtcatattagttcaattgatcaattgcaaggcatgagatatgaaacaaacctgttcccaaatggccgttttgctccccagcccttcatcagcactttttggcgccttcgcttgtgaaactttcagaacccgaccgaaaagttcggcctggtccatgttgttgatggcctctttggcatccgcaggatcctcaaactcgacataggcaaagcctctgtgaggatcagttgcattcggagcatcgttttttggcacttggacttctacaatctcgccgaatggaatgaaggcgtcgagaacatggctatttgtagccagaggtgagagacctccaacataaacggtggccttccacctggatgatgtgtccgtcatttcaagtcttgtgaaatttgaattccggtggtgtagagaatagcgaaggtcttctgaaggattgcacttagactgaagctataccagcactcatacactatttttgaatctcatcctcgttgcattcgaggcacaatcatcacgtgacagcactaaggacaatggaggctttaggcggctgttggacagctgtccagcttggaaggcgttggtggggttgaggtgggcaactccccctttacgtcttacctaaagcacctaagcttaggtcctgtccagcaacagcggtggcctgcaatctggcatcatatcgattcgccctcttaattcttgctgccccaacgacaaaagagcattcagttgaatgcctatctgctggttacagcaaaccacaattggatcatcatttttttaatcttttccctatgtcaagatacggctattgaaacaggatccatccgaagcacaagcgagcaccccccccatcgtcatacctctatagtcgagtgcttccagcaccatggtgcgccttagggaactgccgcggacagcgaccttttcctggtcgtcaggatctgggaagcctcttttggtgaccggcactcgagctggcgctgtcgacgcagacttttctgatgagagcaagctggagctctgggacctgtccctggacgacccaaagcagggcattgagcttcaacccatcgtgagcatcactaccgagtccaggtatgcattcacaacaaatatcatggtggacgagcttgtggttgactagcttcctaagattttacgatatcgcttggggaccccccgactcagaccacccccgtggaatcatcgctggcgcattggaaaacggttccctcgacctgtgggatgccgagacgctgatctctggggaagatgcactgatgtcacagacaacaaagcacagcggccccattaagaccattcaattcaatcctctcaagccccatatcctcgccactggtggcgccaagggagagctgtatatctacgatgtgaacgacattgagaacccattccggttgggtaataccgctgctcgatctgatgatattgattgtctagcttggaatcaaaaggtgtcccacattcttgcgactggcggagctgggggtttcgttacagtttgggatttgaagactaagaaggcctcgctcacactcaacaacagccgaaaagcagtgagtgcgatcgcatgggacccgaacaactctaccaaactcttgacagccaccccggacgacaacacgccagtgatattcctttgggatctccgcaattccaatgctcccgagaagacccttcaaggccacgagcaaggcatcctatcgctttcttggtgtgcccaggacagcgacctccttctatctgcaggcaaagataatagaaccattgtatggaacccgcagactggcgaacgacttggcgagtttccagaagtcaccaattggacctttttgacacggttcaacccacacaaccctaatctttcagccactgctagcttcgatggcaaaatcacaattcaaaccctccagaataccaaccccgacacttcccagtcggctgcggggaagaatttggacgatgaggagttcttcagtgccgctcaaacacagccacagggtgcttcttggtctttgagcaaagcccccaaatggtatgaacgacctgtcggtgtatcatttgggtttggtggcaaggttgttgtcctcaaacaggccgctactcaaccaggccagaagcgatcctctcaaatcctgatcacaagcttctccgctgactctgaggtttcagtctcaagcgaaaagttccagtcatcattggcttctggtgacctgaccgctatttttgaagataaaattgaacaagctggcacggaggatgaaaaggccgattggaaagtgatggagactttggttggcgataatccacgtgggaagattgttgaatatcttggcttcacggaggaggatgcggtgaatggcgaggacattacttctaaagacgctgagaaggaggacgatgctaagcccgaggcggagaccgaggaagagaacaagaagaagagactgtctaacttcttcgatggcggagatgccgatggcgaaggagaagactttctttccaatctggcggctaacaagggggccaagactgacaaacccttccatcttttcgccgactccgacacatctatcgagaaggacgtgacaaaggcactcatgctcggaaatttcgccaaggcaaccgatatttgtctcaagcaggatcgcattgctgatgctttcttgattgcaaactgtggcggccaggaactagtcgacaaggtccaatccgcatatctcgcccggaagaacggaatcccgagctacctgcgtctgatcggctcggtgatcaccaagaacctctgggatgtagtctacaatgccgacctggagaactggaaggaaaccatggcgatcctctgcacctattcagaccccgcagagttccccgacctctgcgaggctttgggtgaccggataagccaagaaggttcaagaaaagatgctgctttctgctacctggttggctccaagttggagaaggtggtttctatttgggccgccgagttggatgaagagaagaaggctggcatcagcaccgaatctgatgactccacgttctctgtccatgcgagaacattgcagagctttatcgaaaaggtcactgtattccgcaaagtgagcaagttcactgatagcgagaagtctctgacctctgactggaagctggctgctctgtatgacaagtacacagagtatgccgacatccttgctgggcaaggccaattgttggtggctcaacagtatcttgacttgctgccttcgagctatcccgcggcagagctcgctaggaatcgtgtcaggttagccacacaaaagcccggatctcaagccaacaccagcaaacccgcaccaagaacgtcatcaagggctggctaccagaatccgctcgtcggagccactgctaatcaattcgtcggagccgctgccaatcagttcgtcggagttggtcggcagtcaccggctcctcctactcagaaccaggcatacgttcctcctggccaagcacaagcgtacccaacgactcaaacccagccatttgcttcttcgaacccgtaccaaccccaaggaacattcaatcaacccagttattcccataccatggcaccacctccggtggcacctggcccccctaggaactcgactccttcttcagggccaccgccatccaagtccaagaatatggaaaattggaatgatgttccccttgttacaaaggcccccccacgaaaatcaacaccgagtgtgcaagcaatcacatcgcccttccccaaccaaccagccaccttttcggcccccccccctccaggtgcttatgggcaacggggtgtagcatctcctccccctcctccacccaaggctgggcctcccagggtacagtcgccgcttaccgggtctcagtctttccaggcaccgcctcgaccatcttcggctgcgaaccagtatgctcctccccaccaagccagctcaaacccctaccagcctccacacgctatcccaccaatcgcttcatcctacaatgctcctccagctgcagccccttcctcaaaccgatatgctccttctcctgcggcacagcaggcagctcatcctcctccagcatctattcctcctccggctggagcgtacggtgttcctcctcagcagccaccttcaaacaacccgtatgctccttctccttatgccccggctcctaaccaagggcctggtgcgcctcagccgggccctcctcctcaggcttctcgacctggacctccacccagttcagcaccagccgcggcaaccgccccacctaaagccgctgctcctgccaaggccagacatcctgcaggtgatcgatctcatatcccggccagcgctcagcctttggtagagatcctgagccaagatatgcaacgggttgcttccaaggcaccagctacatttgccactcatatcaaggatacacagaagcggctgaacatcttgttcgaccaccttaacaacgaagagttgattcagccttccacgattgagcagctctcacagctggccaatgcacttcagtccaaggattatcctacggcccaaaaaatacaagtagatattcaacgggacaagactgaggaatgtggtaattggatggtgagtaacccctaccagatgaaacttgtacgtgtggattttgctaataaaccatctgcccaggtcggcgtcaagagactcattaccatgagcaaggctaccaattagccaagtattcgaaatttgtcagcaccgatagtctctaatcgcttgaatatttttgttagtgaccgtgctcactaacaagggagtatttgtttgaagggcggccgcggaagataaattagagtagaaaaaatccatgatgaaatcgtcttagtgaggcttgatgaataaatgtcttttttacttgtacgatttcccctgctacctactcattgactactgcgtgtccctatgcggatgagaactaccgcttagcttcgttagccagccgccttcggccagccaaataaagctccgagtctgtaacaagatggtttgtaattgagtgtgatacattacccaacgcagaccgacacccaacccccaagcatcatcaaagttattacttgatctatacctcatgcatcattctaggtgcagatccagtgctcaatctcttctcacacatgcgagatgatcaggaggagtgaaaatcctatatttatgaccctgctattattatagctcttccaaaatagttagcctggtcaccattgactttggggtccgtaaagggtgtggtgctaacctaccgaatctgatgtaagagaattccagtcggccctgtggcgcataaggctcgcgatggctggctacctaggtagtcatcatcatcattaccatcaccattgccatagccatcaactaagtaagacatggctagcgtcttagaccttctgtcgtgtcgtcttcgatcaatatgcttccgaggatccgatatggttgggaacttatttacttataaatcttcgaagctccccccaagtataactctgttccatcattcctttcgaagcttcgttaacactgtgccctaatttccaatatctacctactctgcatactcaaggtatccagtcaacatgcggttcatatcctccgtcgttgcggccagtgtcgtcctggcagaggttgttgcaggtgccaaagtcccaagggctttcggtgtcccatcggatgatgggttccccaatccgagccctcagcagatacttgatatctctcagcgtgccaagggaagacttccagatggagccactcccagttcattgccggccggcaccgtcacggcactccagctcattgccttcaacgagttgttcgagactgctttcttctcctcgttgatcaacaacattaccaatggcgttgacggctatcaagatgcccccaacggtgctgttgaaatcttgactgctgtgctagctgtgagtcttgtcccagcccctttaaatcattttctaaagttcaccgcgttctgatatccacacagcaagaagagctacatgctctgggagcggtttctatccttaaaaccgcaggggcatttgccccctctccatgccagtaccaattcccagtcgccaagctcggggacgccgtcgctctggcggaaaccttcaccgctgtagtgttgggggcgttacaaggagctaacaagcagttctctgttgacggtgtctccgattttgttcagttggtctcgtctgtcatcggccaggagggtgagcagaatggtttctaccgcctcctcctcaataggataccatcggaaaagcccttcctttccttcgtgcctgcgccttatgcattctcagcccttcagctcttcgttgtccctggttcatgccctttccccctcagcaacatcaacctgcccatcttcccgacgctggcaaccaacggaggacctgtggccgtcatccaaccaaacgaccagactctgtcgttctcggcggatctgaccacatccccgggtgcccagcagtacatcggaggtgacggaagcggcctctacttgacctacaccaccggacagcagcaacccttctcagtcagcatcaccaacgtccaatggaatggaaatgtgatcagtttttcagccagctttccgtacagcgcaaaccagatggatggtttcagccatggcgctctcactactaccaacaatcctagtttcgatgctctggtacagtgtacactggccgccccagccgtcatccaggtcaacaacaacatcgtttagacactattgcgcacctagagtagtgtacataggaaatagaggtggctggatatgcaaaaatagtgtttgctgtttcaataataacttcgtttatcttagtcgtagtcatctcggcagtttaatccgtggcttcactaagcgctgacgccgcgccagccggttaatgccatctgacatcagggggcgccctgagatttgtaatgtgccgaattaccgttttgtccagaaaatagagtaaaaagctacatattgctgctgtgcggattgaaaggaggttgtttcggaggagagtgggtgtaggttagcacaatgtcattggtgacgtcgaattggatccctgtcaagcgggtgacattaaaaatggcacacccaagaccttcagcgtcgaatttcaacacaatatcaagacaataaatatcataataaacacaatatcaagctaaatactatagaataattaattgcttcagatcattgcgtttagtattattatctaagaaacgaggttcctgcctttcatgaaaagagctttggtgtgctatgttctatttcaggcactgtcagtgattttggggtaatgacccactgtccacaatcgacgataacagaaaagacacctgcctggaggtgatacgttgctcgttgacgttgactatccattacctacacccaacttccctgccacgtttgccagatcaaacaatcacaaatcagcggacatgacagagagcgtagcgacctccaacaatgctgatgctgctgctcagcgggcctcagagcaggcacgcctccgaaaggaacggagggaggccaaactgaaagctggcggctctgcccggctcaacaagatcacgggggtgggcggccgcccgcagacaggtaagaatctcgcacaagaattaccatggtgaattcgagctaactctccctgctagactttgacgccccgccctcggcaactgcagcatccgagcctattacgccggcaccagctgctcccacgaccgcagcgaaggcagcagaggcaactgctgaccccgacgaggtggatatctcagagcacttttacgcccccaagaccaccgccagaacgaacaatgttcctccccctggagctgagccgaacatctccgaggctgcgttgcgccagatgatgctgggcttcgaccccgccgccggcggccaaaacggacagaacccagctggacctggcatccctggcgcggaggaggaccccatcatgaagatgatgagccagatgatgggaggaggcgcgggaggcccaggcgggatgccgcagttcccctttggcggcgacgggtcgtcgttcccagacctaagcagcttctccaacctccagcaggagaagaagccgcagccgctcgacacctacaccgccctctggcgcctcctccacgccctcgtagccctcggcctcggcctgtacatcgccgtcctcaccccgttcacgggaaccaagatggagcgcgagctggctgccctctcggacgaggagaacctgcaccgcaaggacttcttcttctgggtgttcgccacggccgaggcgtgcctgctcaccactcggttcttcctcgacaagggccgggcgccgccgcccgggatcgtgcagacggttgtgggattcctgcctgagccgttcaaggggtatgtgcaggtggtgttgaggtatggccagatattcactacggtgagggcggacatcttggcttgcatgtttgtgcttggggtctgttcatggtggagagcaagagaattggagtaatgcgttacaggccgttggatcaagtcgaggtagatgatagacggccctttgaatgaagtaaaagaaatcacccactcggggcgttcagtattaataatatatgtctcgcagaactctaccggtttactttacaatgtgactctaaatgatcatgaacacccccgaagaagccaattatccaacatgttacaatattctatcaaacaccttcatgttcgcatgatagaattgagcaacctgccgaagacacccctcacccgcttcgggttctccagcacgcaggttgagatcacagctgcgctagctgcgaacgcaagtgtttccttgtactgtttctccgaggaatacttgcgaggaaggatggtcgccagcgcacggggggcgacgaacaaggccatgtccttgcggcggctggcggtctcgatgaggatgctccagccgcacaggccgcagcccaagcccacgcagataccgccgtccatacgctggcatgcctccgtgcttcggccgtttatgtaggggcctatgcgcgtgcgggcgaggcagatggtgtagtagaagatggtgatgaagctgccgaggaacagggaggagcgggatgcggagatgaacgccttgaggagctgtttcttctcgagcttccggaccttgaaggcaagggccaggggcagatatgtgtacatggcccatttccaggaacgagccagacggctgatggcgtgggcctcgcaggactgtccgcgcttcatatggaccacctcgcatgggtaggggatggttttggccgggtcgccccagacggcgggcatgtccaagccgacacacattgggccgagcagagaagcttggccggtgtcctcgccgtagcggagctcgttgaacttgcatcggcgaagggcctcgatgagacgcatatccagcatggcggcggaggtgatccatttctggtaactccgcggtaggttgttgggatagtagaaccaggaccacatgatgaaagcgcatgatacgacaaagatggagggatcagtgagatagccggtgagctcctcagcctaatagatgttagttgagctatagatgtgaggctgacttggctttttgatgacttgcctttgtccacttgtgagcttggctgcgccggtcacgatgccgggaccatagctctccaacgatgatatccagagctctagtgactgtaaataaggtaagatccagtgtatgaccaccagaccttggcgcaggcttctgatgagaagggtcctttgcggcagggtcaacactgccattggcacttggggttgtgctagctgagccccttttctggtgtagaaggcgcatgcccagccatgcagaaatgaatgccgatatccatctcgcaagtctttgaattgttaagaaaggtctagatggttggatagtgagactggcatacctgagacgagctattccgctgaggtttttgaatgaacgagtgagaagaataaagaatggtttctaaagaaatgaggaaggtattagtaaaacagggataggatgggaagcgatcatttcaaagttgtatgtctaatagacttgtgtatgacagcataagcagccggtccacgcaatatgtaggtgagtggaggtgggttataggtgttataccagaagtagagtgctgccccccgcaaccacggcgcaaaacgtggggaagcgctgaggctcaaagccagttgcaatgatgtggagcagtggacggatcaaagagggcgtctcttcggtcttggactgtttcgatgacttccgacgctttctagagatgtgactgacgattaaagcgagaagacgtggcccgacagtggttgcgtagccggtgacataggcgcgaaccaggggtcgaagagctggtggaagagacgacaacgcgatcaacccagccgcctggcctggagtcgacttggagatggcctgtctaagctcatgacctatctttcggtctagggacatttctggaatttggagagtagcatccgggcggcaatcacgccgctcgaagccacgcttattatgtgatgcgaagcaggggtgtgatggtcattgggaggctgcaagataaggggcttcgggcagtgtcacctcgaacgagtagaggatcgcgtgcaagcaacaccacagtgtatcaccggccgcaatgttatgttcaaaagggaatgatatgtttgatcaagatcaaagccacggcctcgcaggtgaagcagttagggagatgagtagtgcttagtcatcacaaccgccatttcacctcgggatggtctttcatgtgaaagtaatggcatgtgttggagttgagatttagatagtaaaatgccagctgcgtctagtggcagaatctaaattacagaaatctggcggaattataaaaaaaattgacattacacctgagacactcaaaacgctggacgcagccgatgatacacaagttggttggtacctacggactgagttctttgaagtgacagcaacagcaacaactatgaacgagtaaatgagagacgagggcattgggtatgatattgaatatattgtgttgtatgtgttgtatgtgttggttgtgttgttgatattatattcttatgttgggatattaatatgattgaccgcgcgcatcatttgttgcagcttctggctgaaaatgctgcactagaaactgaaccctgcacgtgtttcatgagctgctcgtcattcacctacaggtggtatacccagtcgtactagcgatcttcatgcgttggtggctgccaaggctggcggtgcccaatggctacagcgagttccacagcgcttgatcacccctcatctggtagcgggggaggggagaacataagcggcggcatgaggcacgcacacagcacaccttaccaaacatacaacgtaccggtacatagggaattcagccggtttgcgtatgtgatttgccaggtcacagcctggttttgagtttcagaaagctaataaaatgtgacggcatgactctgggaagctgcattattttagagctccaggtgcttgctgggctgtgtgagtggcattggctgctgagtcacgccgagaaacgtttccggattgaggaagctccatgagtcgggggagcttgccgttgtagaggggaaaggtatggcaagtgcgacatggcatgtagagggaggggagggttatgcccttttcctaccaccaccgcattgcgggtatcaattgggccaggttccgtggcggcggcgcgagtccaaaattgctcctcactggtggcgagagggagtcttgagtggcctgggcctggcgtgacttctacttacttgcctcatgttttgcccttttccccattgagtttctcttttgctagacataatctcttttagtctatctatatgactgcggcctattgcggtgtgactcccacgcaccttatcagcttctgctaactttggtaggcggcttgttgctcaggtcaccatcgccgcgatggtggggcaaggtgagctcgcatgatcgtattttttttcggtccttgtcggtaccgtgccaagcgcggaacaatgcgctaaacctcatgtacctcgcctcgacagaccatatgtaatcagtcaagtacaggaacagaggtatacctaaggcgtgcgggagcagtggtgagaggcaatggaggttggccacggtttagataaaaggacagctcggttctcgaacatgcctttgtaatgctcctgctctctacctgcttaggtatcaaaagagaaccttccctgcaatccgaaaaggcaaattttttaagcaagcagtacctcttggtgctgcaaattaacctgctaagcactgtgtcccacctctgagctgcccgatctgagtgactgagacgtcaaccgcggggccataaaatcacatagtacaaccccgctttgactttcttcctctcccacatcaccaccaattttttccttcaacacctacaggcattcaagccaggtaaaagcaaaaataccgccaagatggtgaagtaagttgtctctgatgtccattcttgctcggatcaactcctcttgccctcgccattccttcatcgtcgcctcgtcgtcctcgacgcaacgatgctggcgccagagcgcaaaaaaaacagcgccctgcccctccggagataacactatgccctcagaaaggaaaaaacagagtttgctgacatattgcttcaccatgatagcttcacggtcgacgaggtccgggccctcatggacaagcccaccaatgtccgaaacatgtccgtcattgcccacgtcgaccacggcaagtcgactctgaccgactccctgctgtccaaggccggtattatctcctccgccaaggctggtgaggctcgtgccaccgatactcgtgccgatgagcaggagcgtggtatcaccatcaagtccactgctatctctctgtacggtcatcttgatgaccccgaggatatcaaggatatcgttggccagaagaccgatggtcaggacttcttgatcaacctgattgactcccccggtcacgttgatttctcctctgaggttactgctgctctccgtgtcactgacggtgccctcgtcgtcgtcgacactgtcgaaggtgtgtgcgttcagaccgagactgtgctccgtcaggcccttggtgagcgtatcaagcccgttatcatcatcaacaaggtcgaccgtgctcttctcgagcttcaggtctccaaggaggatctttaccagtccttctcccgtaccatcgagtccgttaacgtcatcatctccacctactttgacaagactctcggtgatgtccaggtctacccctacaagggtaccgttgccttcggttccggtctccacggctgggccttcactatccgccagttcgctgtccgctacgccaagaagttcggtgttgacaagggcaagatgatggagcgtctctgggtaagtcttctccctgcttgaatgcagatgctcccctcccacgatggcggtacaggccagtcgcatttcaatgattgtgtacttactcggaaccacttgtagggcgacaactacttcaaccctcacaccaagaagtggtccaagtctggtacccacgagggcaagcaacttgagcgtgctttcaaccagttcatcctggaccccatcttcaagatcttctccgccgtcatgaacttcaagaacgacgagatcaccactcttctggacaagctccagctcaagatctctgctgacgaccgccagaaggagggcaagcagctgctcaaggttgtcatgcgcactttcctccccgctgccgacgctcttctggagatgatgattctccaccttccttctcccgtcactgcccagaagtatcgtgctgagactctgtacgagggtcctcttgacgacgaggccgccattggtatccgtgactgcaaccccaagggtcctctcatgctttacgtctccaagatggtgcccacttccgataagggtcgattctacgccttcggtcgtgtcttctccggtaccgtccgctccggtctcaaggtccgcatccagggtcccaactacacccctggcaagaaggatgatctcttcatcaaggctattcagcgtaccgtcctgatgatgggtggcaaggtcgaccccattgacgacatgccagccggaaacattgtcggtctcgtcggtatcgaccagttcctgctcaagtctggtactcttaccacctctgagactgcccacaacctcaaggtcatgaagttctccgtctcccccgtcgtgcagcgctccgtccaggttaagaacgcccaggatctccctaagctggtcgaaggtctcaagcgtctctccaagtccgacccttgcgtccttacctacacctctgagtccggtgagcacgtcgttgctggtgccggtgagctgcatctcgagatttgcttgaaggatcttgaggaagaccacgccggtatccctctgatcatctccgaccccgtcgtccagtaccgtgagactgtccagggcaagtcgagcattactgctctttccaagtcccccaacaagcacaaccgtctgtacatggttgctgagcctattgaggaggaactctctcttgcgatcgaggctggcaaggtttccgcccgtgacgatttcaaggcccgtgcccgtgtcctcgctgacgacttcggctgggatgtcactgacgcccgtaagatctggaccttcggtcctgatggcactggtgccaacttgctggttgaccagaccaaggccgtccagtacctcaacgaaatcaaggattccgttgtgtccggtttccagtgggctactcgtgaaggacccgttgctgaggagcccatgcgctctacccgcttcaacatccttgatgtgaccctgcacgctgatgctatccaccgtggtggtggccagatcatccccactgctcgtcgtgtcctgtacgccgctgcccttttggccgagcccgctctgctcgagcccgtctacctggtcgagattcaggtgcccgagaacgccatgggtggtgtctacggtgtccttacccgcagacgtggtcacgtcttcaacgaggagcagcgccctggtactcccctcttcaacatcaaggcctacctccccgtcctggagtccttcggcttcaacggagatctccgtgccgccacctccggccaggccttccctcagtccgtgttcgaccactggcaggttctgcccggtggctctcctctcgactccagctcgaaggtcggagctattgtcactgagatgcgtaagcgcaagggtatcaaggctgaggtgcccggtgttgagaacgtaagtcacatccctactgatccaaaaaaggctttcgaactgtgttggctaacatgtctctcctctagtactacgacaagctgtaagcgaacttaccttgaatggatgatatcagatcctgtgtccttgtggatgcagaacctcaacaggctgctagcgaagatctgggacgcctgcctgagccccatagagaagccccttgcgaagacatcaaggtggccttttgtcaaatgacaagccgccgagacaaggaaccaaaaaaaatatggtaaataaagtatgagggctagattgaggccataatcacggggaagctctccgcttggcttttatgtagtgatgtgccgatagtggaaacatgacaaaagaaatgatgactttttatgttcaatagtgtggctcctgatcccatgcctgtgtttgtgaatgcccatgtcggtcccaagaaaccaagcaagactgggctgaatctattttcagttgtacaatgagtgagcgtgaggatgagatctcgtatggaacgaggagcgtggttgcacatagctcgtgcctcctcgtcttgtgtcaagctcgctcaccgtaccttgctgctgaacaatcgacttacctaatcgtagtagtgcctgtagctagttacccagcagaggtggagcctgaatctgatcttgggagccagaccagattctcaaagtgcttcaaagtttacgagcgcctgcggaagaaaaagttaccaactacatctatcgattgccagtctgctgagagcagtctcatatttgggcgaattggtttggcgacgcatcgagtgccctccgaagacaacgcgatcgcgacagaagcgagccgaccgcccaaagtttcatgccgtgcatgaccttcgccctattctccggcttcgatgcctttacttgaggcaccatgatattccccgaagaagatgcgcccttgctgaagacatggattgtgaaccgaatcgaagacacgtacggccccctcttcttcctaccatttaccacaccttcaagtgccggagctcatcaccttcccgctttctagatctaatgcagacgccgaggtgttggcagaatatatcatcgcgctcctgaagcacgatggcgataaagcgtctgtccgcgcgttgtgcgaacaggagatccccgactttttgagcgaaggtaccgtgctgctgctctccctcgccactgcgctagctttgcgcctgggtttcctgccaaatctacctggtcaccattaactcatgtcacagatccgaagcctttcctggacgatgtgttccaggcgattgcgtacaaatcctacatcccgggcgctgcgcccgctcccaaactccagcctcgcaggcccgaccccccaccgcccgaagcagatgcagctcccagcgcgggccattctggctccaagaaacggagctacaatgaccgagacgacgcggacccatctgggaaccaagatggatatcagaatggtggccgaccagctaaacagcagcgaaaacgcgggcgaggtcgaggggaggacaagcgtggggacttctcagcgatgggtatgcctccattcgacccccagaatccggctaccatggaagcattcatggcaatggccatgcaataccccgggatgggacagtttatgggaaatggctctcgaggccagccgcggcggagaggcagatgccgagacttcgattccaaggggtactgctctcgaggaacgagctgcatgtatgatcatgggaatgagtctctatatattccaacctccggacctcagggcgacggtgagatactctgttttttgtcctcctttcccaaggcatatgatagctaacccatgtttgatttcagaatatgaccccgatcaggccatgctctcaggcaacttattcccctttttaaaccctcttgcttttaagcccgagaatagtcgtggccgtggtggtcgcaaaggaggacgggcaggccgcaagggcggaggtcgatcgaatttctctgccgaaggcccaagcaatgaccgctcaaagaccgcaatcgtggtggaaaacataccagacgagagtttgaacgagaccgaagtgcggaagttcttttcagagtttggaaatatcaatgagatatcgatgaagccgaacaaacatctcgcaattatcaagtacgatcaatggggttccgcaaatgcagcatatcagtcaccaaaggccgtctttgataaccgatttgttaaagtctattggcagaaggatgagagcaacacggggaatgggtcgcatccctccaaggacaggtcgaaagatcatgacatgcagtacacagaggatgacgccttcgaaattgaccccgaagaatttcagcaaaggcaagaggaggcccagaagaaattccaagaaagggaaacgaagagggcagagttggaacggcaacgcttggaactcgagaaaaaacagcaggagctgatgcagaaacagcgcgaagagagggaacggttgcaggctaagctgttgaagaagaacggcggagttcccgatgccccctcatcgggggcagacatgcttcgagcaaagatcgcctcgctggaagaagaagccaagatacttggcttggatcctaatgccgcggaggatgacatcaacatcagcgtggaataccctccgcggggaggataccggggcagatcaacgttccgtggacgggcgactcgtgcgtggagagggagccgcggaagcttccggggagtagacggccgtcatgctgcgtatgctcaatactccatcgacaacaggcccaagcgcctcgcgattagaggcgttgatttcacggcaactgacaaggatgagagccttcgccacttccttttggtacgttattcccatgagttgaaccatagagtcccccttgctttacatcaaactaacatgggagacacagagcctcggagagttcgagtcggtagagccctcggcaaccacgacatttgtctccttccgggaccgcaagacggccgagaagctctacaacagcctccacggcagcgagcttcccggcgtcgagggcaagctcgagctgtcgtgggtcagcactccccttccacccgttgcgccgccacaggacaaagatagagacgatgtcatggcgggcatggacgaggacaaggcgggtgcgcagccgcacaaccagcaccagcaggcgcacgatgatatcgactacgaccagcagggggatgatgccgatgcttactagcctcttaccttagcgagattaaacaatgaatagagataatatctggcattacatattgcccagatttgactttaaatggcggttgagagtttagagcttctgttaaaagcttctgttaagaaagcagcacatcccatgagtgactgaatttcattagctctggttcatttccttttgggcattcagacgaatagaggtaagtccctttgaatagagtcactagaaatgcaacatgaagactgttatatctcgggtcaaaaaggaccattcgagagccaagagccacgagccatcaaagacgtatgaatagtcatggcggttctctccggcttcactttgtattttttttatttgctattttttatctgtctgttggcatccttcgatccgcctcttgccaaaaaccgaagggtagttagtccgtgatagatgaatagatctatccacttacaacctttcccctcgaatcttgcctagtttttttttttgacagatcctgcgtgaagaacggggctctccgctgaggagagccctctgcagacagtatctatggtgtcatggagggtctctttgcctccactgttccatggcctggggtatcgttgagatatcatatgcatgctatatgaaagaacaagaataggccttgggattcttgttgttttgtgttttcttttcctccccattctcctccttgcgcgtgtgtcttcttccccgatgctcgtcatgtcgtgaaagaagggagatgtaacgacagcaagtattgtcctggacaacatatgatgccgtcggtcacttgttgtgcccatcaccctcctttgcgattagaaaattctcgcattgatatcaatgcttcactccactcctcccgtcttatagtagcacatgtcttcgttatcatgaaacccagccattgaacctcttacacgaagagttctagtgtacctttttgttgaaaaagacactctttcgtggtaaacgcccgcccgatgcattataaaaaggaaacgcaacaaaaaagctcaagaagaaagaaaagattcaaaagaaaggtgatgcagatgagagacgtagccaatcatctttttaagaacaagcagagggtgatggatgcttgttacccagaaagtcccggttagtttgccaccaaggcggcagcttccttgggaatcgcctgggaggcgtgactgccattagtcacagattcctgattgtctgtttgaccttcaaaaggcgactctagttccttgaaatcaatctccaggccgtcaaagagtttgaaaatgctctcgttgtcatggaagtcgttgttcactagggagaagattgttaggtaaccagatttgtcaaggaaagatgctgggtcgtgtgttactcaccgatgttgatcaggtgccagtcggtcatgatatgctcaatgagctttctgctggcagagcctgagtcaaaacatttggcccaatccattcccaattggaaggcctcgtctctccatgcaaggaagctgacgctctcgacgatggtcggctggacaatctccttgccgggaaagacgccccatgtcacggcattagggccgtcactgggtgcgttggtctcgagctggccagacttggtaacggcatagtaagtcaggtcttcctgcttagccatgcggctggtcaactcctgatacagtcgcggatggaccagcacctcaaggtacgacttctggtatacatatccatttgaggggccccaaccgtggataggatgagatgacttgacgccgtcaacagcaggttgggagttgacggtcagaatgccccgtcggttgaggttgaccaggttttccctgatggcatctgcctcgcctgtcagaggagattcgctccaaggtaatgtctcaatctcattcttcagatacttgacaaagagttcagcaatgtctcgataggattgaggctccccccatttcttcctgttggcttcgttggagccagtcaagccaatgccgtacgcatcgagttctccaaaggcaggagaacgagagtcaccccatcgcccgttgggaaattcgtcccagtcttgcgtgcgcaaaacgtacgcctttgtgcggttacgccagaagatgggtcgcacgtcctcgtcacgacgacccaagcccttggaaggcttccagggcagtgctggctgcaggggtcgctcggctgatggggtccattggagctcttccagaaccatgcgggtggcttgagcaaggttcatggtatagaagtgcaagtggaagatgccattggcgagcagtttgcggcacatttcagcaaccagggtcgtaccaatttctctcacagcaacatcgtcgttcttgacaggttcaaggcgatcgagccatgcttggggaatcttgcactgcatgtgattggccctgcggaggaagctggcgtatgttgcaactggcatgatgccgggcagaatgggaatgtcgatgcccttctcgcgcaccttcttcacccagcggataaagttgtccacatcgtagaacatctgtgtaacaatgaaagaagcaccttcgtcaaccttctccttgaggtggtcgaggagctggtcctcatctttgttgtcgtcgcacccctcggggtaaccggccacgccaatgtcgaaatgatcaccgaattctttccggatatgcttgacgaggtcgcgagcatactggaacccgtcctcggtggccgtccacttctcctggtcgcgaggggggtcaccgcgcaaggcgaggatattggtgcacccagccttgtaggccctcttcagagcgtcgttgaccttctccatacccatgtcagtgcatgtcaaatgcatgcaggtttcaagaccgtggacggcctgggcttggtggaccatctcgcaggtgagctcggcaattctgccacctgcaccccaggtgatgtcgatgaacttggggccgaaattgtacatacggcccatgcgatcgtagaggttttggacaccctgggccgtcttgggagggaagtactcgaaggagaaggacggctggccggtgccctcggcctcggtgagcatctgcttgatatgcatggtggattgtgtgggagcggtgtcgagggaagtgtttcgatctgaataggcgacgacaacgctctaggcggtcggagaagaactttacgccttcaagctaggaaataagagtgcgatcaagctccgtgacctgaagagagcgacggctatgaaatggaggagaggacaaaaaaggtacacctgccgggcaagcaaagctgtcagtcaggaatggctatgaacccgatgcaggagaagacagattcggcgctgccaacgaacagaaggggcaacggtgagcctgcaggtatcccatcgaacgcaattggatcgatctgaaatagctgcaggtcgggaagcgttggaggggggtggaggggcatgggggacgagggggtttaactcacccgaaacaggttcccagctacacaacagcgccgctgttggggtcgtcgagagctcccaacggacaatcgcgaacaaaagagagggtgaggaggggaagggaggagaggggcgggagagtgtatctgcacggggagggacgcagatgcgaggtaaggtgaggatagaaaatgaagagaaggaaaaaggttgaggcaatactagagtcacgaagcgagcaggtcaacggcagttttgcacgggccaggcagcgggagctggggccaaggaccaagagaacaagggtctttgtgtgggctacaaggtgacaggtcctggcttacagcgacctccgatagcgggtacaggcatgagcggtacatgtactttgaaccctccaacagaacagagtcatcggccagtcttcagatgccaggcatggaggggtaccactgcattgcccagcaggcaaagaaaaaaaatccagaagggaaatgcactagcgatggaaatttctccctccccacattatctccgtctaagacggcctgctgctcttgccctgggccttgattggctgtgttggttagcggaggcttttcctcgtcaccttcaaccagccggtgcaaacatgtgctgtagcgacgccgtggtagaggcttgcttagcagaacctaagtgaccgcctacctactccgtacctaggtatcattcagctcccctcaagatggctaattgccgctgatgcaatagcatacttgatcgggtctggactccgtatcatgggcaattccacaatgcatggtcagtcagagacacattccgtgatccccgcactcttggacagggatggacagatgcattgaccacaccaccacggggaccaacatgacgcagagtggcagaacgggacagctgctcaccgccctccttctttgcaactggctggttcagagcgcgtaacctttcatgttagacccaatccgtcgcctagcttatggtctcggagtacattattgattactgatttctaggaacatgctgatgtccgtaaagacaaacttgtctcgttgattacactcgttatctatcagtacatagcttcatcacattgtaacgtaggcatataaagggggaacccatcagctccccttcagtagcagctgtggcgcacctcgacgttttcgtaaccgattgctcgtttcaataatgccccgatcaaacaggaaccaccatcgctcaaagagcacctgtcctacctcccagctctctgggtcgtagggatccgatccaacgcgtacaccctcgctattgtcttcaaagtcataggcaaaattcactagcgccagcgggccccgggccccaggcggccgcgtcgactccggcatgttgaacatggtgagcaccctgtcgcgcacgctcggccagggcatgaagtcgagcatcggatggtgggggatggtgatctgtgccatggttgggcgccaggcgacgggtagctgatctgacggcgtggcagtgccctggttgaacggagatagacagtccaattcccacatggcgctggtcgcgcacccgatgcgttctgcgatcctcttgaacgctcttatgagtgtgagctcgtggactgggagcaggtagttgtctacgaagtcgaagtcggattccgaggagctagagagagcctcgaaggaggacggtgatgatccgaaagtagacgagaaagtcggcgtgaatgcgccattcatggacgtgaagcctgactggtctaagtaacctgcttctccgcatacgctctggcccgtgaaagtactaaaagagtcggatgaagactcgataagagccgtcacatcgggaccatccaatgagtcccaaggaagcagctccagatctgcgagggcgactcccgtgtccccaccaactgaacattgtggttgcgttactactgttgcattactgcgtacaggtaggggcgacacatcagcgtcgcttgggaacgaaaggtcctccgactgggtttcgggagctccatctccagtatctttgcccgtggaggcctcatcttgcgctttgcttttcaggcgctcctggcgcttcctctcgcctggccaaccgagtcagtgaaccggccggtggaaagcggtgtgccgaggctggtcgtgtccttgtacttacgatatctgcgttgagccaagacattcaggactctcttcctctcggctgcgtcctggtctatgtctgggacatctagagtgggcggtgccttgtataacctttgtcgtgtccgggctctgacggtctctgaggctcccctgcactccagactctgggatttgttcatggcccgaatggaatctttcaaattctatctttggcctgcaataaatgaaaggtaaagagtgaaaggggacttaatttggaaggtaagttggatatcgcgatggaataacggcttgcgttatggtctacctttatacttgtcgcaggttcgactggcataacgcgtagtcggcgtaagactgtgtcagcttaacggataagcagtactagagcaaccgtactgatgtagtggacagagaagtctttcttaacaataaccatcgaaaagtggatccattacacagtgagatgcaccgtgtgaagccaacacgaaggatgcgaagccaaggtagtcaggaggtttgccatggttagcaaccggaccaagtgagccttggcatagcacctgagagcccagaagatgatggttccagtatcaggcatatgtggaattaaggtgcaaaagaagttcagtggacaatcggttgctaccttgtctcggccatgtcctcgccaggagcacgaggggaaagaacaaaaaatgggagagatatataagaacgagaacagaggtgaagactcgtgtaaaagaccgaggcacgaatgcagagctaaaggagataatatgaagatggagagctgacggaaaggtacggtacccctacacgggcggtttggtggattatttatactgcaggagcctggccagatcagagtggcataacgcctaaggataactacaagcatctttgggcatgcaggtaaagaaaaaaaacattatcatctacccggtccgccaagcatgtataattggtgtgttgccattgccatgtctggcaagccacccctcacttagctctgtcactattttggatgagcttctggagacaaggaggggcaggattattcgttgtaaataatcccatcaaactcaaatatgcaatcatctgcctagtttcaactactcggcagttacggggaggagaagcggcaggtgacttcctcacatacgaaatggacgccttccttcctctgaaggagatgcagagatgctaggaaggtgtttatgtagatgctcgaaatatcactttcctcgcctcgtagatagcaagtattttgttgtctcctcaccaacatcatacaaaatatacactctgagctgccagcaccccattcttcatcataacaccaatatcatatatttcagcgcgtcttggacagcctgcgccatggcttccatccatgctggcctgccggttcatcgaccaagccgccgacgtgtatctttctctccacaaggcggcatatctcgcatgccagggtacatcaacgagaccaaacccccttacccccccagacgttggaagagggtggttctacccaaagagctgccaagccttcgagagggaagcaccgagactcccacagaccaagaatcagagaccttgccaaccgagatcaagcccagctcagaacctccaaccggatgtgtttacaacgtcgcgcctgctttccactttgctccggccagagtgcacaatctctcagaaagcaccgtgtcgttatgccaagaagacgacctcgtcgaaatgatgaaacattcccttcacctagcgacacaagctccttccatcatgtcaaaagaggatactccgtctattatgtcaaaagacgatgtagcctctaaggttcgagatacctcgtcatcatacgggtccaaagacgatgatctggtccgggccaggtctccagcgtcgccaccaagcctaaacacgctcaacgaaacaaacctttcaagatatagcgaaggcaatgaccagctctctaacctacactcgagccctcgcccgaacacaccttgttctactctacacgacgctgctgatgaggcagctgctaccgcaaatgagtggaagtcggagccccgtctagaaatttccacttgtgatgggcttgacctggacaagggcgaagaagaggaagaagtcctgccatctgattctgtctctcaatgtcgcgctccacccgacgtgattcaaagatgcccaaggtgccaatgcagcagccgggccacgttcgaaagcacccgtgcaatcaaaagtcagtacgacggaggtggtgacgccgccggtttcgaaagccctcagtttggcaccaagctacatcccatcaactttggagacaaattccagagcaagaaacgaaagccttcaaccatttccctcaagagcatctcgggccatatcccgaaaaaggccaagaagctcaaaacctttgccaatgacattattcaaggaggcactatccggttcaacaagctcaaatcaaaactgaagaagcagaatgaacacagcagatccaatttcgaagcatggaaggctaatcgtcggcgggcacgaccaggtgatccaatcaaagggaaacctcaaccaagctatgccatgttcaacctggagaagagtgttcacggcaacaaggatgactggtggaaagagggcgttcgtcgttatcgtgcaccgtcgtggatggtgttcggagtaggagctcagcctgcggtataatgtaatatagaccatcagttggcgagcaagggccaaaattcgcggacgtgttgggtatcaatactgggtgtatcgcatatgatgaattggctgagtagacgacatccacacaaggttggaactaaaccccccaagaaataatattttattccaattgccgaagatcggtattttacagatttatctgagtgttcaaagcatgtagcgaaacgagtctggttgtgtttgccgcctcccgttcccaaccaaaccctcctcctcttcgtcaaccagttgagaggctcgctccttttcaagcctatccatcttcctgttctgatatgacatgtatactcgaagaatgatggccaaaatggcgaccccgagcatggcccagaagcaggtgcgcatgccgtgcgcgtagtacggcccgtccttgaccggatacaggcgtgtgccgaccaggggcccgcactggccgatgagctgcagcagggcgaagccgcctccctgccggctctggttggcctggttgttgatgctccaggtgatgatgagggtgacgacgttgaagaaccccgcggcggccgggtagacggccacgtagcggaagacgggggagagcctcatgggctccgcgacggcgaggatggcgtacccagcggcagaagcagtagcgtggaggacgatgggcacggtcctggtgcggaagcggtcggagaggtgggcggtgacgaggacgaggaaaaaggcgacgaggtaggggggagcgctgagggcctgggcggagaggttgttgaagcccatctcggtgaggatcttggggaggaagacggggagggaggagtaggccatgttggagaggaagaacatggcggcggagatccaggcgacggggtcgcggaagacggcaaggagggcctggccctggctgccgcccgagtcctccttctggtcgggcttcgtgggggtcggcttctcgccgcggaggcgtagcctggctactttacgctcgcgcttggtgaagtaagatacggtctggggggagtcggggatgactctgaaggcgatgacgccggctatgactgaggggaagccctcgatgaggaagaggagtcgccagggggcgattggactcagctcggcacacttgacgatgacccatgccagggaggaagcaaagctagtggcgagaggagcagctttgcagttgtcatgttagcaagcggattctaatgaactccagtataatgagatggaggaggacgtaccagagatgaacatggcggtccggaaggcaagctcgtcccttttgaaaaagaagctcagatagaacgggattccagtgaaacccgcctcgctgattcccagcacaacccggaagaatatcaacacaggatatgagggcgcgatggactgcagcgccgcggtcgcgccccatgcgatgacgatgccacagacgaacttgtgagccggtataagcctccagagcaacgccatccactcgaaagagatgtacgatatatagaaagctgtgagagaccaatcgtaccaatcgtcgcggggcggcttcgtctgaaggtccttgtccatcccagcaatccgagcgtttccaatgtctatggagaagagttagatcacagcccccaggccatccaaaaaaaaaaaagaaggcaggtatcaatcttactggagcgatcgaggaagcttagcaagaagagcagcgcgacgaacaagacgagcttgcgatcaagcttcctccggactgctatctcctcgtccggcgtgtacagctggaagctggcgaccgagcttgtgctattattacgcatgtccggccggggcgacatcagctcgttcccctcccaagggcgctcgacggtgagatccctccgcgcttggttctgctctaccatctggtatacctcggccgccggaccggcatttccaacaacctcggagcgtagatcgaagtcgtcctcgtcctcgtcttcgtcgtcttcgtcgtcttcctcatcgctgtcgtcgagatcaagctcggccccagtctgtgcgaatgagggggagatgtggccaggccgaaagccggggcttcgtgtcggggtcgcgagatatccagggctgccgatttcgctgtcgtcgagactgaattcggcccccgtctgggcaaaggactcgccaggctcctggcccgaggccggggtaagatagttttggttatagccagccatggcgtccgtcgaggaggagccggagctagtctgtcatcgggagcgcgatagcctggcgacagacctttgtcatgctcagaagacggctgccccttgacgcagtctaatcgaccaattgtggtggtgaaggtagtggcagcttactacaggcgctgttagttaaggatgacggtgacccgaaaccacagctggcggcacagttcaacattcacgtgacgcattgatatccttccttcaatccttcaaccccctagggattaatccaattatatttaccaggattcagcatatttagcagctggatgatttaattattacgcggagatccaaatgtgcgtgggcaatgcaggtgaccagcgcccgctgctggtggccaagagaggctgtccgggccaacttgaatggcgcacaactaggtacattgcaaggctctaagcaggcagtagtgttgattaacatcccgaaactcttacttcgtcatctcattttaagacagagagcattgctttgctattgggtgttttctatcatgtttatttcaagaagcacctatatatgtagctgtctataagtctaagttagcgggggtaaggcaagtatctgcatactacagtcattttcgaagtacgatctctttcagccgtttcatcctcgacgatggtcttttcatatcctgctgtttccccaaatcatctatgctgttgtgattcgtggcattctctccctgctctattttctcatcagactcattaacctgcgactggccaggcatttgctcagtcatgctcgtcctgcgtcccgcctcaacaatgtcatcctcgatcccgttcactacaacaaaccatccgatctcctcgtcctcctccagtgcgtctctcagtttctcaaaccaagagccatcgcctctctcgctggctatccgctcataacgagcgatctcctccgtcacatcagcgctgagctccacccggacagcatagtcggcaacatatgcatgtggccggcacggctccacggtctcacgggggtcatattcctccaagagcttcacggcggaccactcatcgttaattaatacggggtcttgatcgaggcgtgcggtgcggttgtcatcgtcgccctcgccctcgtccccatctgtgagacccccggaacgcggtataggccgctcggagagccctctaaaggacggcggccggggcagaaattcatatctctcgtagaagtgcgccagtattgccgccgacgagccccggccgacgatccagtccggcgccgcatcgagcacgtcgtagatgatgacaaagaagcggatgctccggcgatgccaccggaagccgtgacacaggtaagtgggcattctggtaaagaatgtaatgctggagcctcagaaacggttcaaagacgctgacgctataactcctaatgtgatgcaatggaaatgtgaagatttactacgaatctatagaggcaattatctctgcgtatatatatgagcgtgttcaaatcatatagatcgtgatcgagaaacacaaacttgaatcggtaattgaaacaaagcaaccacaaggtaaatatctgcctgataatcattacgagcttcctaaggaagcatttcagaaccttggtcatggtacacgaaaatactggaaagcgcttgctcatgacaaattcgaactaagagaatcaaggtatgatggatgagcgtggtgttttggggaagaataatcattacaaataaaaggtaaggagaccccaaatgccggattccccatctttcagcactgccaggatcggatgaatggagtctgacacaatataaacccgtttatttggtaatcttaagtaatacagctagtgctaactaccggcctaatgcgcccattccttcaacaaaactccgtcataggtattatccatacatccaaacgtatcgagtggaatatcataatcaatgctgcatattgcacgtccctcatcttttttttgccctgtccaagaaacagataattaaatcgaggtcggatatcagctccaaacctcaccaaatcccatattctagatgcacgctcgtcgaatagcaagttgtggctatatgcactccacccatgccaaaatcaccttttttgtgtgtatacatgacatcctcttggatatcatacaacggaccctagtcgttgaaaccggccagggacactccgccatctgactctaccgccctgtcatactgcccagtgccgaaatcaaagtccatgtcttggagcatgtactcgaggtcctcatccgagatattgacatccatattcttcggcaggcacgacgtctccgtctccggttccgctaactcgacgccggggcatttctgcactatccattcctggaatttcgccaaaagcaccggatcatccactggtgtggtgtcagtccccatgacttgcctggcgtggcgcctcaggctgtccccggaaggtaatcggccagtatcgacaacggattcccttgtgaactcgagcagtcggcgctccagctcgcgagaacagaagatggcggcaggtcgctgatctctagatgcgagattctccaggaaaccgttggcgcccgactggcctgcagagaacggcttggtcccagccctcatactgatttggacatcgccgctgaacggctcgagctggctcttggggaatgtgtaagggggggcaaacccggagcctccctgttcaacagcccaggcagagcactctgggagacctgggccggcatcgttaattattccagagtcgcgcttgaaccgttgcagccactcggcgttgtctgctgctgtttggttccaaggatcatcgctacattcagttagtcgatcgtgtttggtcagtctaggataatcatttgggctcacctctcatagataatgtaccgagcttggtgtttcaactcctcgtcggatggaacgtgctggtttggattattgggagacatagtagccgcaacccaccgtcccagttcctttgacagtcgacgatagcagtttgcatcgttgaggaagaacggggtcagcttgagaagattcccgttcacatcgagagctttgggcgcagctctcacagcatccggggaatggagtgtgatcggggtatccgtggtggtcgaagggtgcgtcttcgtcagagagagtcccggtgaagtttccgtcaccgcggggctcaagtcgtggagatgacgctccttgaaagctctcaaccacgaagcattgtccgcagcggtttggttccatccgtcgtcgaattcgtatatgatgatacgcgcttgtcgctggagatcttcatctgtgggttccaaccccaaagcacgctgatcccggaggaagtcgcgcagctcgctttccaaccttgtataactgtggatggtagaatcgatgaccgtcgggtcgttcgatcggcatgtgtcgttcttcacatcttcggttctcggtaggtgtgctcggcgtcggaaatcggctagccagtgggttgaagaccggatgagtcgaagcagccagttggcaacgatgtctgaaggatggactgagacttcctcgacgcgaccaacaattctgcaagcctcctgctgcaactcatagtccatagcagttaggcccagcaggcgcttggccctgacgaactcttgaagttggaattccagggggcataactcgaacaggttgtccttgccgttaattttgagtgtagccagtctgttttccgtagcaccacgaaggggtccaaaacgagctttgagggccaactcctctatcttcatgatgacatcacgaagccaggagacctctgatgcgattccctgaagcgacaacaattcgctagcgtaaataatacgacatccttcaaccatgagctcctcgtcggtcgggtgggttccgttctgttccaaatagttggctgtgaagtattccaattcgagtttaatcagttcgtaggcattacgaggtgattgcggcgaaggctggcttgctacgtaaggcaagggggagttcctttcatgatgaatcaggtctatattctcaggtgttagaagtgtccagctgatctatggggtattgtaaaggtcgcatacaaggaggaacagagttttcgaccatatcgagcactgagctgtcaaaaccccagtctcccttccagtcagccatggaataacctgtcttgaaatgctctgccaaatgatcaacacgtattgtccaagtgtccatcacaatgccgcagaacccgcaacgtgacctgatttccggagccgcaaccttccaagatttcatagaccagtctgcaaacttgacattatggaccaaacgaagatgctggttcaagtgatctttcctgtaaaaagtccgctcggcagccgacttctcctggcacgttgagtggttgtggctttcgatgtgcgattcatctggatcaactatgccgcagtatacgcagcttaggagcccggtttcggggttcacagctcgtgaaccatgtggagcgcacacccaccgctcaagagacaaatgaagagatttttcatgccgttgccaatcatgcttagtccggaacgtctcagtacagaaagtacactggaaggtccgagggacagacttgattcccttgccactttcctcttggctctggtttggcgtgggccttcggcgacgtcgccgacggccatgattgctgaaacgggcagatccaaatgaattgcgggatgcataggagtaggcggatccccgggagccattgctagattgcgaggtccccaaactgctaaccgaggactggttgcagagtgaccgactagacccatcatctgtataattaacggtgctgaaggggctgtttagtccagacgagaggccagacgatgaagccgtcacggcccgtgcgatggcagtcaccgaggccggttcgttttcggggggagagtgttcccaacgctgaagggggttcatggtttccaatgcgggtgttccacgtcgctttgggatatcgatggaaccaatgccgctcgacgaccaattaccaacctgtggtgaagtagaccgggggggttggactttgccacggcgtcgagcatttgccagccaattggtgatttgggttttgctcaaccctgtgtttctttgtagcatctctttctcctcgtcactgggataaggatgtctgttatgggtcgtcaaccaggttttcaaaatgcgaaccgactccctcgagaagcgggcaccgattttggctggaggggcttgaggcctgggcgcaacgagcacaggtccatcggacacggcattggtaatgttgagaaggtctgctgtcgctgtagtatcgcgattgtacatggcagtttcgtccagaattgcacttaggtcgctgtccaggcccgtcattgaagccgctgggaccgatacagatttcgggttcaggttggcaggcacttcgcccccaaagctgcactcgagggttaaagctacgcagctggtgcagtagcctctgtaccgaccctctctgattttcttgcaagagtagcctcccagagaacactgggagcaggggacggcaggcgtctcccagaaggaagcatgaaccattggtccttgggtggcatccggtacaggggctggaatgtccataccattggcggccatgtgttggtcggtgaagtgctgaagggcgttgaagctgaagtcatcctcattgatgttctcaaagacgaggtcggtatccatcccagcaaaggcggcgtcgacatcctgctgaagggagaactgatggtcgtcttccatgaccagctcagggttgtcccaattgacaaacttgtccatgtcatccatggtagccatgatggtacaagagcacggggggagttgcggtccgaaacgggtctcaagggcgtgcgggcatccagaggtcaactgaaaggcgcagaggacattgacaactgtcaagcacccctttaagaaccgacaagtgtgtcaacgggtcctattaaccacacctttgatcgaaaagactccgtgtaccggggcccgcgtgactgtgtatgattgaggttatagagcatccacccacttgcttgattgacccaggagataatcaagaagaaatgggagtcacaagaacgctagcctcaggggacggtctgagagttttgttctccaggccagaaaatctggccttcttcttgattctgtgtccaagtgcgagccagatctccattgcgcagccggcagcggtttgcaccaggccgttttccagtcatcagcgctgactcttggggccccacccatgtctacgccctgcggacgacagcccgcatgttgatacggtattatcagtactgtgttccggggcgagatctggtgaggggcacagtgtttgaggctgaccacctccaccctggttcccttctgccatgacccacaaatattgccaaagggcgtgggatgtcatgtacatgcaaatagcctctagtgctatgcaaaacgctaagccaacggcgtagcagaagtaccgtcgtgtctgcctgccggcccacaattgatcgtttcctttgcggtggagtgacgctacaactgcgactcggacaccatctttttggtcgcacgagacccacccaccgaaaaccggcagtgcctccacggttctcccacctgggcatcctcccaggctgatcccctcgtgccccttcaccgccatgccgctcgtcgcactctgcagttcatgattatcatcatcctcccagcatcatagaggggtcagagtagcatgcatgcattgaaaatcccaacaccctgtgcccctcatgccaattagatttcccctctattcggcagtttcaaccgaggctgagacgtgaggtgtggctggctctgaaccagcgagaagtttctcgaatttgcattgaggctaagccttttcgcaccaacccagccaacaataagcccgctgaactgctctgtcttaaaggagaaccggaccgtgattcaagccaggtctacccaaaacttggaatgggtcttttttcttctttttcttttacatcagttattgactaagttttcagttgatggttccactcttttttgtcttcggaacacatctactactaaaatgcaactcccagcatatagacactctggatacatatgaatgcaaagttcaatgagcaacagcgtcgaacaaatatgttttgttgattcatgtcaagctgctggtctctacaccatgcagtgatctaaaatatcattaccccattgaacatactcataacacatcaagttcccaaacccataatgcaagccactcatcaaaaccagatctcttgggggtgtcagtaacccatcgacgccatacaaggaagaagaaaaaatgtaaaaaggaaagtaagctagatgaaaagaaaggaggagaggaccatgtagacttttatcccggcccgtgacttttgcgtcgtgaagttagggccagctaaaactgacagtaaccagagtaagcaagatatcaaatccgtgtaatatttgcgccgtgttcgccggtcctcgataaaccccagatgaaagaaattctagcccagaaaactccttactcaacccaaacgggtcataggtcgtgattaaggccgccataagatcattgacttcccgttcttttgtttttttccccatcattcatgccccaaggccattagctcacgctctttggctgctagcatctctcgcatttgttcggcttctcgttgcaaagctgctcggcggtcagctttggaattttcaatctcgtcatgaatatctgaatgtgttggagtaccatctcttgtcgaaaatatgctggggctaggctgcggagtaagcttcggtccaggcgatcggagcgggggcaacgagtagtcatttcggtcatcgtggccgggtccggggttcaaaatcgatttgatagaagagagtcgtttcggattgtccacctctccatcatcctggtatttagtttccacctccgcagatgaaaaggaacgtttcctcactgagggtagaagagatgccggcgataccgaggctctcctatcaacaacagtatgcattgatgccagtggcggtagccggttatcgtcattgaatatttggggagattgccgggggcggagtgattgttgatgatacgaagccagatccgaagctgttgacataggagacggctgccggctcgaatgaatagcgggtcgaggctcaatagccacaggcagactagcaggtctacgcattccgagattgatggagccatcgtcattaatcgtacctcgttcgggtgtcttctcgtagcgatgaccgtcactcgattccgtcatatcgtccatttcctcatcctggcttgctggaataaccctctttctgcgtttaatggtagctttcttcattgtaacaggacgatgtacgccatgtagtttataatagaggcctgcctaatggttaaccaagtcaaaaaaaaggaggacattcaagatactaaccacaagcattgcagatcgtgtgcccgccttcgtctcgcctccataagggtgtcacagtggtaccacaattctggcaggcaatgacaactgtggtgtcaggattttgggcctggttttgcgactggccatgtgactgtgcttgtgactgagtctgtaaagcattgacatcaatcggttgcggagtatttgaagcgccctggtcacgtcctccacagccggatctttgtttaacggtcaaattagcgctcttggataatctgttgttgaaggctgggcagccatggcatccttcggctccaccagttccattacaacggccgccaccagggcatgtcccagttggagtctgttcggcagtcacgtaggtggcaccgggcacgccctggcctgccttcggtgcaggggcaatagatgtaggctgcgatgacggtcgaggggtcgattcttgtatgacgcttggtggcttcttcaatccagtgggacgggcggcattccgtgccttcaggtataagccacaggcattacagatcgttgcgccctggggggatcttctccaaagaggcgttcgtgtggttccacaattactattgaatacgtgagctgagagtcttgaacgcaatttcataatatcgagaactgacctgcagacttggccgccatgagagctggacacggcgggagggcttgctttgggggcaagggttgcagacggtgtattcgggctatgcgattggtacgaggagacatcaagcatcgaaacgtcttgtgacgaaggcgagacactggtagatttcgtttggttcgtacgatcagaggggccgcccacgaaatgagccgtcggggttgacgacatcgggcgagatggcagagcggtccggatagcccctggctctcgatgttggttcagagtgttcctcgagtgaggattgttgtcgcccatggcgggtcggcttaggtggagggtgtttgagaaagagtttgctatgttggaggcaaggtttccgggagtagtggcgcaggcagcggcagacagagttccgggcagtagggaggacattaacctgcacagccagctagcgagcctggcgcactcggtccgagcagttatccaagtcggctgggattggcaacaccgggttgaacaattactggttattgggcagtcgtaattaaaccctaggagccggcctcgtggtcgcaaaacacgtggattggaaggagatatcggacaccgtctggtacttgaattgtcagctgacttcgaaacaaggcgatggcgtaacggccctgggagccatccaaagttcgtagatctactccgatcgccacatccgatcaagagaaggccctttgttttgatatgtagcatccaggtacccaaagccaagtcaacgccacgcaggaggtcttgtgtgcctaacgaaatgtacacacttacgaaagggagaggggaaagactgggatcatccagccctgcagataagtcaatgtgttgcaacccagggcgaaacggctcagcccaatgcaatggccagaatattccttggctaccacaaaatccaatcacactttagctgcgtccgggatcgcggattcaagtattcaccatcccaacaggagcagaggagtgtcacagtcgcagcaactcggaaaccgacacaaggcgtaaccaatgagcggtcaagatgggaggcaatgattacttttcgcaagtctccgattggacagacacctctaatctctgtcgatgctattgcaaatactccacctagacatcgcggcttttgctagggtgtggcaatatgtcacccggttgggagtggatatgcactagtcagattgcgtgccggatctagaaccacttacctaagcaatcgcgtatgtgcctggttcagatttcaacgattggcgacaacatcgcgacccaacgctctggtgctttccaacatgacgactggatccgagagtcccaagcgtgagcctactccgaccacctcactctcctcagttccccagaagcggctcctcgatgaaggccacagtcctgctgtgccctcgcccctcaaccccgatgtgaaccccaccgaatctcatttgaccgacgacgcgccgccgtcgagtcgcgccaagtcggtcagagcgaagaaagacaccctcaagaagcgagaagccaagggcggtgatggagaccgtgcgacgccggatcccaaacgtccaaaggaacagaagcacgtcgaaggaggcccccttcgatacaaacttgcgccgcccaagacatccgactttgaagcgcctcgtccgcgcgtgttggcctatcatcatgaagtcgaaacttccaatggcgagactatacagtttttcgagaccgcagaccagtaagcaagacccgaaacccgtcttctcggggttccggtggacggtggacatgcgcgattactgaccaaccaaagtgttttcaacaagaagaatttccgttacacccattgcatcgcagaccctctattcccgtcaacggtatattatcgccagactgaagtcgaaccctttgggcctcgtatgagttatgaagatgctgctggtcacgtcttttttgataaatcagcgcgacacgtcacgacagacaaaggcttccgcatggcacgggggaatgttgcggttcgagaaggaaggtcgtactgggagtgcaagattacgcaaggaatccgcaagacgaatgatgacggctcaaagccggaaggcgggcgacatgtccggatgggctgggcccgacgagaagcgtctctcgatgcccccgtggggttcgatgcctatagctacggcatccgtgatgtcgcgggggagaaggtgttcatgtcacggcccaagcccttcttcccttccggcgaaaccattcaggaaggcgacgttatcgggcttgagatacgtctgccatccgagagactccatcggaaggttatggctggcacatataatcctgcgatagatcttatcgaagaggcccaggatatgcccataactgctgaagcagcgaatatcgtccgagaccgagttccaattcgattcaaggcacacacatactttgaaaagatcgagtaccactcgaccaaggagctcgaagacctcatgaacccctccccagtcgggtctggttcgtcaacatctgagccaccaaaccctctccataggtcgccagctctacgcacactaccgaattcttcaatcaagatttacaagaatggtgtattgatgggtactccattcgaagatctcctcggcttcctaccaccggcgtcaaagcctttgatgccccaggttggcgcaagagaaggatttgatgacggcatgctgggttactacccagctattagcatcttcagaggtggcgcggccgaggtcaacttcggacccgatttctggtaccctcctccagactatccacccccaagcacagagaatgcggacgccgccatccctcctccgacacgagttgaaacgatgcatgcggtttctgagcggtaccgggaccagattgcggaagacgttgtgttcgacattatcgatgaggtggatgtgtggatgcaggacattctggattctccagacagttcttcggatgacgaaaggaactacaaaactaagcggggccgaggaaccgagattaaggaattggttcaagaagattaatatagaagactagacctcggtcgagctcaagatacccctatgagaggaaggaacaaaataacatcaaattaattccagtagttttcatccgaagacaaacaatcaaattctatggacactatctgccaaactccgggacaacaaaacagaaatttctttgattggtcataacttggggccaaatcgcattcccaagggccctcaggactgtagtggttcaagaacaggaagaggggaagggtatgctagataacagacattatttcaatatgaccctcatcaatacgtaactttcattcatcaatactcaaggcattggcctcgttgtaattttgtatccccacctaggcgtgggatgggccatttggccgcgacgcttcagctgttctggtgcctgacccggttgcggagtctgcggccagaggctcggttcgagtagctggtgctggaagttgggggtcgtctggaagctcctcgatacggtctgcaccatcaacaactccctgggcctccttctccttctccaggcggacttccttgccacgcttgtagcagtaccagagaacgaacatcagtactgtcatgccgttagcttcacccaaaaacataatacataggaaggaacctacaaaacaaggcgacactccaaatcacgttgacaccgataaaggccggccagcgcgcctgcaaggttgatacgatagccctgagcatgctcactagggcacctggcttcgtgacaagttccaagaggttctttggcacgaataggttcgatgcagcctccttgataccgccttccatggaagcctcaagcccttggctcttggccgctgcggccaggatctctggcgcaatgctgcctgtgactttttcaggcaactgcatcacgagcttctggagcccggagggcagtttctcgaagcattttgagatggtgccgtcacggtcggtgaagagcttgacgaggtcgtcgtaggcagttggcacgccgttcgcaagatctttgaagacctgtgtgaatttggccaggagctcctcggagtcattggagaggttgatgaccttattgttcttcgctgacaggttcagacggtcgagaacattgttcaggtcacgcttctccttctgcagctccccttctgacaacgatgcggcatcctcaggcttcagatgggaaccgtgctttgacctctttgagaataggcgagagaggcgatttggtttcttttcctcctcaacggctttccccttgccgtcgctgcctgccttgccgttctggtcgtcttgacttgccctgtccctgttcattgacgatgcgtcatccgatggccagtcaatctcaggaacggggacccgaggtggcagcggaggcgcaggaccatcttcggacccatcgtcagacaataagcttcgcaggaatgcttcgtcggagcggtcaagaatggggtccccgggagctggttgggagtgagagctcccagatgcttccggagcatgggattccctctccttgccggccccacctgagccactctcttgaccgtgttgggccttcttctcatccctgaccttcttgatcttcttaattgtgaagtactccaacatctcgggcgcgttttgggtgaggtgaatcgatacaccacgaggagcaagtgagtaaagaaagaaaaaaacagagagtgacaatgcttcaccaagagccaaggcgagctccgcttcttgggtagttatacggaggcacgccctatgagtcccttgcgcaagccagagacaaatcatgtgcttggggaccagcaagcgccgcgctcgctgcaccgccacccgaggtgatgtcattcagccaccatccaatcccaccaaacgcccacactccatccagccgttttacgctgaagcgatgatgcccatacagtctgcacgtgaacaaacctggtgaaacagctagagaatccaggataatgcggtatcatctattggtcgtcccttcatgactcattacattattttgatgccttaatctttgggtatcttagcctcctagttcacaagaagacgccaccaggctgcaagttctattcgtcgtcctcctcctcatctgcgtggttcatagccgagcttcgtcggccctgtgtgcttttcgcgggccgccgccgccctcgagcataagcgtccgtctgtgtcaccgcccgctcgccaacatatcttgttccatcaaacggcgtggaacacttgggacatgtttgaccaccatggattcgccagaagttgtctccacaatgctcatgtagccgtaacagacagcccggttcgttgcatctcagtccaactgtgagtaattccttgcatgcctcacagaatttgattcgctgccaatcgccgccgtcgtcgttgtatgtttcgatcagccaaggtcgcagctccagtagaccacgaggggtgaggctgtaaaatccctccttgcttcgctctagccaccccccaaggacaaggttggagagagtcgtctcgacctcgctatgtttcaatcccttatcgacagacgtctgtgtcgcctctggtgcatcgtccgagatctgattccgattgggcggccgggcgaccttcatcgcctgcatctgtgtgatggccatgatttccattcgcggtgaattgtatgtttcgaacattgcatcaaacaggcgcttgatgaatgagagctcgtcgtgagcaaaggtcgtagcgagctgggtctggggatcggatcgtgtgttgacaaacgcatagattcggtctttagtgacttgatgaatggcggttcggatttcataatcgtatattgaagcagcttcagatgctctcgaaaggtactgcgcaaaatcgtcttcggtgacttcatgtcgcccttcccgcccctcggcttcccagattcctgcgatgattgggcatgcttcgtcaaaggtcaaggctcctcgagccataatggcttgcaggaaggctcgattgccattgttgtatcccgagctaagaagtgcctccatctcggccttttcgcatagaaagtaattcgctggcaaaatccttctgccacctatagatatttgcagaatcgcgagcgcgttctacttagctttcgcgttaatgagttgagctaacttgaaccccacacacacatcagttgctgactcatctcgtgacctcgcgttcccagacaaagcacttttccccttgaaaccacctacaagttcaatgcaagcttccgcatggccccgggtcggagctaaacaggtctgtgggcttcaagctgcatggtgatagatgaatgcgtcgttctttctctataaaagaaagaggaggcttgcttatacctcaagaggttgctctcttgcccaaccaataacctgttcagatctccacctctcattttcaccatttgcctgctatccagcgagagaaggacgccatctgaactgatcccattggcaatcgaggcaacaaaattccaagcatcacttgacaaacacgttgatggcatatggccgcctactcagaggcatactttaatattaattaaaccagggtttctatctgtcgaagccatgactgatactaaagactttgacgttatccgcgtctgtcgatccgatggggtggacactgggcccggatattggccagttaccacgccagcagcgaattcgataaagaaaacaacagcagacaaagcaccaagagcaaaaccacagatgacaagacttgctgaagatgatccaagattcacagaatggagagtgaagttggggattctactcaagcaagagttatcccagagtccagacggtacgtctcccttttaggaactctggtagttttcaattgttgattttgttttcttctagatggtgtctcctggtatgtgccatttcctaagggatactggctctatgaaaagtcaaaacatctttgggtttccggatacccaatcaaggcgaagctcttcaagacgccgcaagagtttgcgctgcatttgatatggctgctgtcggcgtcaatggattataaggactgttgttgtgtccattgcaatgttcctagtctcccgaagcagactccttcatctgacgagggtctcgctcatatgcctaacgaatcgcccgttaaacaagaccatattattccccacaaagtcaccccaattcctgtcccaacagttgttggtcaaccaataccaacaaaatcagcatcaccggcgcagaggccacaggccacacacatccaaccgccttctctacctactccgtcggttatcacgcccccgactgcaacgcctgtcccacctccccaaatacctatgtcttctataccgccacaggtgacacaaccggcacccaaggtccagccacctcaaactcaagtccaaccacctcaggttcagcaacaccaaatcaagcaaacaccggtccacccacccccgatcccacaacctcaggcccaaccaactcaagtccagcagcaaccaccccaggtccagcagcaacctcaggtccagcaacaatctatggtctggcctctaaagtcatcgctattgttccgtgttggtgagctcgtttggtatcagaacgggcaaacctggcgcctaggaattatcggagccttcaatagcactcacggcttcgaacttgtagccattggccataggctagtcgctcagcagaatgtcttcaaaactgccaacgacatgcgcccattccacgcattcagcgtaccgggcgtcacaattcaggatctcaagagcaagaactatgatgatgttccctgggaagccatgtttgctgcctatcaaaatgatgcaaacaggcgggatcttctgattctcgatgcttcaaagatggccgcgtcgaaaatagattactccttctcgctctggtcgcccatatcagaagatccctcaaccaagaccccagtgtactacggttgcttcttcggagccgaacgcatcgagattggagatgccctgcgactaaaggccctgcctgccgagtggaacatcacaaccgacacggccgtcctgggcctgcgccagatcctaaccaaccgggactatcccggcgctgtggtcttccgcggccacatctacatactcgtaaagggggactcggggctgacaaacgccgtcccggaggagcagctgcccgtcccgctgagggacgagctcgcgtggcgccagcagactggccccaactcccgctggcgctgggtgctggtcaaggagaacgccgccctcaaggagcagtccatccgcggccgcttctaccccacctaccgcctcatgcccatcctgaaccccgccgggttccagcaggcggtccagcagggccaggcggacgagcagatgccgcagctcaacaatcggatggatggcatgggtcgctatattggaaggaagcgcaacagactggatacactcgggccttcgatatcaggggtgcacggcacgcggctagccgtggagcctcatgtgaaggaggaggcgtaggactaggcccgtcccatcttttccaacgggagttgtgcaacagcctctctccatttcacaattccagtttttgaattcagcagcgtggtccccaacagcgtggtccccaaggtaaaatgagatttaatagatatagggataaaacgatccatttcaaatctagagatgggcagtgctatccccaggtatatggaggggtttgtcaagcagtatctttatcagtgtagcaatagaataggtatcatttatttagtcacgggaacgggaatggcacacacaatgctccagctgaaatcatgtttatccaatacttcgctgcaatgaaggccaacctgtcaagggttctcgagggttgcgggcacccagctcccatgtgtcccgaagcaaaatgatggctctatgtgccttgatccacagctgctgcggcctaccacctcgacaaccccgttctcaaagcaatcgcgatatatgacatttctcgttttgtagcagaaatgaatggaaacaactaaagccaacctcaacccccaactctgtcgcatgtcggttaaatgactcgctttcgtgatgcaagggatcatgaaaatggtaatcagtgatgcggaaacaactcaaacgcagcaaatggaacgctctatcctctcctctacaatatctacagaccctgggtcccacaaattaggagaccctcaaagcctgaagtctagcctcgatcttttcaagtatgtcggggtcgagttcaatttccggttccaccttgcgaggccgagcgcgaacagatgccgctgtcttctcctggccacaactcttacattttgtcccgttctcggaaccaggtggataaagagttttgcacgagtgacactcaaagtgaggtacactgctaggtccgaattcgtcgccagggtagccaagtggatatttgtctttcttgggcctaatgagcagggcgttagtagtgagcttgaatgagagaaagagcgggagagaacacatacgggtctcgcggacagtccgtgcagcggatatgaccgcagccttcacacgtctttgatccgggagggaacaacctcgcacactcgtggcagttcctcctgacccgctgacgaggcttcttatagatcaggtcttgaccaccagtcctgctaggtttcttcagaaccacaggtttctgatcaatgcgataatcaacaatgaggggagcattttctttctgggtcctgatgagctctgcccttcgctcgcggctggcaatcttctcctcctccgtgcgtctaggcgggtagcgagtacacttgacgcaacgggtgtgctggcagctggggcactccttggtggtcgtgaagttcgcatcacacctgtgacaggtacggcgaactcgcattcggatcggcttattgacgcgcaaaacagtgtcgtcggcagggtcgatggtgatggtcttccaatccgtagtcttgatttcaagcccatatcgctccccaagcttcttggccctttcctcaaatagggcggccttggacagcctggaaactccttgcaggccttcatatcttgccctagccgcctgcgcgctcgtcaattggggaggcgccctgttccattattagaattgctttggatttctctggcttattcaaagcagcatggggagttcttttgcgccaaaagagagggcgcagacagttggtagaagggaaatacatacgctgccttgggtggctccttgggcgcctccgtctctcccaatcccgatcccgatccgcgcttcgaggaaccttctctcttcaggatagtcctcgccctggtcaggagtttggtgaaactcttctccttcttctcttccttgaggggtgtacgccctcctcctggaggcccggacgacgacatggcagtggcgaaattcgagagttgctggaacttaacaatacgacatatgtgcgcaacgaaaaatgggtggaatgctgtactgaagaaataagagtgcgaaggcagaaatgctcagctactcttgattcgattcgacgttgagacgttttagccgcgcttgccagtgtagggcgatgaacaggcgaccaacaatttgagaactgagcgacagcgattacaatgtgcacagcaggaatgggcagtcgaggcgaatgcagtcgtgaacctcaaaacatcccgacagcgcggtgcaattgttggctgaagaaatgcagctccgcaaagaacgacggaccttcgatcgagggtggcgatcagggtgtaataagaggcctagcagcacccagagaacggtaacagcgccggcccttgggcttggggggaatccgagatggaggagtgggctgcttgatgcggaaaggtgagcatgcaggcatgtgctagcagttcaacccacatccactcaggcgggatttggtggaccgcctagtccatatcatcacgcccctttagcgagccactcgagctggagtggtggacctgagcgccatggtcccggcccttctgacaaaccattgggtccctggagggctcctggaggtcccgccgacagctggtcccgcaggcccagggagctgggaaagaaccctgtcttggacttgcaccatgtaccaaaataccttcgactcagactaatacccgccgccctcgagaaatgctagctccccctctcggcaccgactcaatccatttcatgcctacctaccctaagataaccttagcagctcactgctccgtcccccagctgtggttagatggccagtggacccgggcaatatggcccgacctccctgcttgctgcccccaggagttcgagccaccagctcgccagctctctcttccagcaggaccttcctacacggtacacacacccaactacgtaatgcagaatcggcggcacgtcctgagaccagtaccttacctgtcagtgggcgaggtagcattgcacatgccttcccaggcaggtgggtgggctgaccaataggacgtgggagggcggcatgcgggctatcagtcagtggcggccgcgcattttttccgtccaggcattacctcagtgccagggacaagcagcgccaaaccttcaatccctaacccaaattccggctactgacttccacaaccgcctgctactctcacttgggcacacaaccatttaaactatcgactggtttagtagctggtccgccatgaagggtgggcaaaccagtcaagggctccttgacgcatgttgaggatctcgggttgagaaaaaagtccgtcttcaactggcatgatgcattgcctcccaaagcaccgttgcagatgctgcatatgctggcattttgtccctctacatcatgcgcatgtttcccataatggatggctgcatcagttggctgcattggtcggcgagtctccagcacaagggcaaaggtaggtgcatacgtacaagggcttcctcaccaccacctaccatccatctcggcggcctgttgcggagcccgattcataaccctggcaccgggtttacagtgccatggagtgcatgaacacagtgaagggatgacccgttttgatattgcgtacccatacccccggcgccaaagccgctcaccagcgcttcacacaaaaaggacccgaggggaaaaaagaggggattcttcaaatacacaatcggcacattcgaaggtcacagtccaggttatggtctgatatcacaggtgatagagtcacgtaacttggcgtactggaaaccagggcgcagctggaccagggaaaaaagcaatgaaataccttgcaagaatcgatgcagtctgccaaccttctcaatggagatggcgttgcccagcgcagtccttaagcgtctgcgtctctgacatgtctttttttcgttcaaggagggtggtcgaaagccgaccacaagatcaaacgttacaccaaaacaagaaagggaggaaaagaggcggccgttcgttaataccggtgaacaagccgttggacatcggtcccctgatatcgcacagtcggaaaggcccgtgtacctgactctctttacatgaagccggatattttccctgaaaaagtccactatgcaaggaagaagcctgatcataccgaagatgaggatcaactcgtcgatacccgccaatagcttagcactaagacttataaaacacataatccgaacgattgcttgatctgcgatgcataatcaggagtggttctaagaatcagcaatgaaagggtcgctacatcatatacggcctatattatcaagtaccaagaaagtgatttcgggatccaagctattggtagacatcaatttacctaaaaccccttgggcgtagatccctgccattcggtaccagagggcaaacgagaagatcaatcatatttttccaaggggaggattaccactagcctccagtcgatcgaccgttatggacgcctgttcttacgaatctgggaatgctgacggaagaattgccggaaatcttagcgctggtgcttgctatgacataacttcaaacttggtaattgaagaaaaaaaaattcaatgtcatattctcctattatcgacaggtttttattttgtcacagtctacttaggcctggccgattacagtattccttgcaaactctcatcatagcgaggttgcagcagacatgcaacagcatcatactttccccattacattcctctacattggccgtccggcgcctcctccatgcgcaagggccgctggcggccgaccaggcggtgaattctatcgtcccatgggattgggtaccagagggttgggtaccattggggaccgtcgtgttctcgcgaggagctgagacatgccatggcctcatggccttctgccgtcagcatgataattaacgctggtgagaaatgacgagagaacagctgtcgagggacccagcaaacgagacgcctactctcggatctgcaggcgaggtgatcgccacctggaggtatgtgaaagcattccgatgcataagaccacacacccagccgttgcattggtgtagcatcgccccactgggagagagaagcggcttaccgcgttggtaaaaatcgcctcaataatgaatagcgtggtggctattgtcatggtgtctcaggccctctgtgtctctccttttcattagctggtcccggtgacttggtttcgctacccgccagaaccagccattggggaagccacatgacagtctcggctgaagtatgcagtacatagataccagctgttcctcgaaacggcctacaattttgtcgaagcggtgaaggacaacctgcgaagaggagggcacacggcacctccatctcgtcgaagtccagtgggcagccgcaagcgagagtcggagcgtccaatctccgtggtatgaccagacacactctgtcaggaggttgtctgaacacggcgaacaccaaacggttccgaaggagttaccgttcaattgggacgcagctcccatcagtctggttgggaaattaataatagccaggcgacgccgtgtccccctgcgggttatgagagcatcggctcgttctgggagtagcaccgtggagcaaaaccatcgacgtggcaccccaaaggccaaacgatgcaaggcgtacgtcttcgcgcatacacccgctgcagcagcgcggtgttggccggactgggcagcttggctactgcatgtcgtgcctcccgcacacgcgtataattatgtacaggaacctggagccccaatgattttgacacgatcttggaggagccggtccactaggaagccatggcgcatccggtagcattcatgtagtgtacatacccagtaaggtaggtaggtaagtatgcatgtacgcccgtatgccggacgacgggtcctactcgcacgcccgttgacgatgcattgcctgtgcgatgccgaagcgaacatatggccagaccccatcggcgtgctctcccagagttgcagtatctagccggccggacatgcttaccctgatttctggccacacgtgtgaatatcttcgctcgagatgatgtagttgtgggcaggtcgaccgcacactccacatcagtcggtgagcaatccccgatccgcaccggcgacgttgcgaacaggacagaagccagttctgtactgccagcgtgccaatggtagaatgccagacagatggagccacccgcccacatgctctgatcttgttggttttgcatccccatcgtcctgggggagaggttgggcaatggggacctgctccgctgagcccagtgcgctgggtgtgccgacagcctacggctagcggtccgtcccatggtttggttaatggcccgacgcttaaaaatcctctcgtgtgcaaaaaatttcacttgatgacctcccaagatgaaagacacgggctatttggtctagcgttgctgctccccgctccagctgccttaatcggccgcagaggctgttctcggcacggcccaggtctctctgttctgctggatttgcgtcgcagtttcgcccagtgttgcggtaatatatgtcggtgggaggctcagtctgcggccagtattgctttgcaggtccagggcagggcagtaccggaccgcagttcgccccaggccaaccctgtcgacctggatgcgtttgcaacgggatggatcttgggggcaggctcaatagtggccagcagcgcattagtgccgtccagacaagttcccccatacaaaccaagacgcccatgctagtggttgattgtgaatactatgtagagtgtccctccatgtttcctaggcccctttactatgcagatgcagctgctttggaccatacattgtcgcccacatatgtgtctctctgtaggtgggcatccctcccatgtccgctgcttcgtgtgtgattagtgagtttttttgcgatgccggtgtcgctcctcggcctgtatcatgtacgttgggtaggtttcatgccagcaaatacctgcaacgtgatgccacaacccaccccctccgaaggcctcccggcagcccggatacaccttgcctaggttcctccccctccctggttatggaagcagtgtcccctgacccagcgtcatgccaacccttgcgcaaggttcggggtgatttgtcggacaatcctctccagacccgtgggagaagagagaattgagctaggcctgcacagaaacgggtttggatgaaacgtcaacaatcaaaaataataatcagccattcttctccctggttcctgaggcccgatatggcatggatgtcgtcaaaacgcctagcctaacagctatccaacggttcggcccccgagctttttggaactctatttcccaaccttggtagacacaccgagccgcagtcccggtaacgtcttaacaccgaggatgagtgtatcgccgctagctattcgccgtgacaataagaaacccctgtctaaccataccacggggagtaggaagctggtaccccggaggatattattaagaaaaaggttcggcatttcttgagtcggatggcgagacgggtgtttggtgccgattggtatggcggacaagttgtgaggtatagggtaggcacatgggtggcacaaagacagacccgggcacttggatacgctgacaaaaggaatgacgagctcaggcactggcctaacgtctctgccggctcatcgccggtaaaaagtcctgaatctcgcgcatcaccacgcgtatcccggaaacacttacttggcgattgatttgatatcatcatcgatcattgatctcagctcacctgctcgacctattcccctaagtatcaatcaccgctgtgacaaccgtccatacctgtggcaactcccagattcatcaaggactttgatagttgtccagctcgtccatcgcctagactgtgcaaaacatagtgcgcagtcataattcttccccccttgacacttcccttcagctttatgcaacaagagccccccaagagttcaacacagcgcaaccaacccgacacatccccaatcgcctcaccatcttcccaacatggcctcctgcaccatgatcccaacgatctgcaccgagtcggctctgatggctcccagagcacgtctccccactctggccctttcgacaatgactcatccgatgggttcagcccagacaagctggacgagaagcttctccggttgagatttgacgacccatcgagggcaagcccaccagttccagggcaaagagtaattgattatgaaaatgccttgatatatcccgggaatcggcattcttttggcttcaaggtcaccaaacggtccgagccacggactgatggggtgcagcttgaggatctccccaatggttagtcttgtccttgaaaccgtagtttagaacccatctaatcgatcgccacaccacagagattcttacgcacatcctgtctcacctccaccccgactctcataacaccgttgctctcgtctcgaagcgattctatgcgctggtaaccaccccacacgcctggcgcatggcgttccagcgcttcttcccaggacacagcattatcagcaacaaggtttcgaaaaggggcgatgatggacaagatgacacggattctgatggtcttcgatcggatacccgatacttctccaggctgacaccgttggcgacttggagaagtgagtacttgtttcgcacccgacttctcagaagcttggagcgtggcaagcctggagcgtttgccgccggggccgggtcgtcagggcgatcgaagcaaaacatcaagaaaactacagctgttttgacttacaattccaagttgccatgggttgtctctcacctccatgctgtatttactaatggaaaaaaacctccacgggctattcagggtacatccgaccttggggttgggaccgtcagtgatcctacaaccggaaagatcgaaaaatggggattggaagctcccaataccttccctcagctggaggaggtggtgccaaacctagtgccgtatggccttggggatggcccggctggagttcccaatgtcatggatgttagtcaaccctatggcctgcttgcgggtgaagggtttcctggcgggcgtgccttcttccgcggagccaacgaggccagtggccgttacctcgacccggattctggagtggcagacagttttcttgatattcccaggatccccgagataacagaagctatctcctgcgtttggcttgccaaatcctcggctgtacctacagtcaccgagtcgatggttggtatgttcgttggatccaccgctggagttgtgacatcttattcccttggctcggactctggtggccttcgcttttcgacgggcgacatgacgggacgatgggctcttagcccgggagtccccatcatctcgctcaaagtggatgaaaattacagcatcaaacgaaagactgctagccgtgtttgggttgtcgccttgaatgcactcggagaagtttattatttgaccgaaacccctaaaagcaccataaaccgtgcccagggggatgatattgtaagacatgcctggcttgccggtcgtacagtcttctggcatctcctggaagagacacggcgtactgctcgccccgaggaattagacaagagcgaatctgatgcctcctattcaccctaccccctttccgactcaatgaagttggacaaggatcaattgatagccaaagcccgggaagccgaaaagtttatgcattatcagccctctcacttcctcaaggtttgccagggctgggatatgcaacgcagacttgaggttgatttcgccaatgactctggggacggcgtgggggagagcgttttcgttattgactgcggcttgacagagagtcaggccccttgtgtcaaacggcatatgcggatctgccctttcaagacggggaagactcacattgacattgaaactcaaccttcggcccctaagacatcactgtttggccatgtcaatggcgaatcagagcccactccctcgcctttggattcacaatcacctctgtcaccgccttcaacacctcagccgcgagccgtctctcttgtttctgagcacgagtggaacacacaacctctggaactcggtattcagaccgatgctacaatctctacaagcgcccttgattcttctcttcagtcaactcacacattggcggaggatgcgcttcatgtagctgatcatctcgccagcatccgtacgtcctcggatataaaccaagcgagtgtagaaatacctggtcgccgcgctcgttttatcgcgattgggacaagctctggagaggtgatagtctggaatgctcgcgacaacaaccggagctctcaaatcgcaccagttcgtgtgattcaaacccagtcccccgaaatttcaagcttggggttgtcagcgctgcacctcgttcatggaggcagtgatggccttgtccaagtctgggatcccttgggttcaacggtagatgcgatcaggacgatcaactccagacacaatggccgagttccgcgtcacatgatggtcatgaatccggcccttgcgcacgagaattattctgctgctggcgctatctttcttgaccctgatccgacaattttaagaggcattgtttcctttggagcctttatgcgttactgggcatatagttcaaatggtcactttgctcatagaaagcgtcgtcacaggcactccgatattcacggacgtattgccagtcgccgccagggaggcacaagctccagatacattgccgctgaggaagccgaattgagaatcgaagatgcggaaagggcgaaggaaaaagcccgactgcgtaataggttcggagtcggagccctcggagacttgacagaggaggaggcacttctctacgcccagctcatatccgaggaagcatttcaccaagaagagcaaatgcgagccagtgattctgctgctgataccagtgcggacaccgcatcttctttcagcggggcaacaactgatactgccacccccgagccaagcattgctgggcctagccagtcaggaaacggccgtatcaatgaggatgatgagtatgagcagcagatacagcaggcgatgcgtctctctctccttgaaagtgggagtgacactgcagaatctccccgcggcaacagcgcaggcgatttcgagttcgcaatcaagtacaagccaaagaacgggaagaaatcgaaggcatctgggtcaggctttccatcgtctacccagtcccctgccaatggcttcgttcttgatggggcatcagccagccaagacgaagacgctgatcttgcaattgcccttagcctgagcatgcaagagcagacgttgataacatcgtcgactgagtttgaggactacagggaatccgaagaattccctgctttggagacggagggtattgggaaggggaaaggcattcagagatggtgaaggggtttgttttcggtggttgtcgagcttcgatgttactgttttgctttattttcaattctcctgatagactcagcgtgcctgaatcctgcagctttcggtcgcatattttaatcggtggcctaaatatacttgaacatttgttatcatctattgttgaagtcccctgcacggcgcgtccgtgtgctctctttgccttaacggctcttggaaaccccataaactccctgccatgattgggcgctctcgtataacttctcgtaattctgcatggatgaaaacttgggctgttctagctcttggtttagtaagcccaatctgagcaacatatattccgtacggaagttctctaactgtgtctttcggaagtcttgtaccacgactaaactaaaatctgctattactttgacaaatctttagactgattggtatatatgtattgcttagaacctccgtgtaatggtataatccggcttccacttcttccagaataaacctctgtggcatatgggtgaagaccttgagcccaaaggtagcttgcatagttcctacattgtattcgcagcatcaaagtctactgtatgaacattggaacagtgtcaacaccgagagaccatggttccgtctctagctaagatgcttgtcatttctcctcccacgcatttgccgggagcactgatcgctcatagggtatcctacactttactgcgactgcttttctcggtatagggtgggcacacagatagggtggacgatgctcccgatttttcttgaaccatgctcataaggtcttgacaacgaggagtacaatctagaatttagtgatgtaatttttggttcatgaagtacggttcacaccttgaccggttggattgggatatattgagtgtctgcgaaagacccctgaagcaaaaactaggacgaattttataaacagcacggcgtcttagacaaatcgttcattgctgagaagtagtgtagaagtttacttgacttgttgaaagtcagctttgttgggaagctcttttcaggcctgaaagatgactctcttacttcacaccgcgtgcttagaaactgcacatgactcctcaaggccaacactgcttgcagatacattgataccatccggatgtctcgacgcagctcgtggctgctaagtatgacaactgggtcgcccctttaccggcaattaatattctaggctggtgctgatcgctcgccttgacatggacgagagctagatgggccagcattacgacgactcattgtcgtgagggacaacaaccggctgctccgtcctcaacaaaatcacattcactaaaaatagtactgtttgatatttgtttctttccttgatctgactcttgtctgtccaacgaagtgccttgcaaagtgtcgtaataatcggtaggaattagaaccgatcacggaggattacgtcgactcagacggtgtttgagccacagcggcccatctgtcttacagtttcgatttcagagccttgctcgtcatctggagagaagtagtaatacgcagaaagcttccctgaagcggttaaaacacacatacataactgttgtctcctaccagtatgatcaaccaacccgtcacgtcctgcccatccactacccgcgagatggggagacctagacgtctcacctgtcaaagtgacaatgagcccgtcgcaccttgaacccgcccggctaaactattctggcgggattacgatgtgcgaagcgttttggccccgccttggtgggtttcacaatacggacgaaatctgatgatctcaatatcctggctgaccagtgacctactttgctttgcactgccgggctcggggaattaatcaggtaggcctacgggaaaggaggtggtctcttctcctctcccgtctgcgtctagatgagggttcgcgcctgcacttttgcagaccatgctgaggggaggcgtatgtgtgttatgctgcgaggcgtgagattgaccagtgtcctgggtcgccacattgcggtccacgtgggaagcgcatgtttggtggttctctgcgtgtccctggcctggattgcatagccacgaaactcgaaatacacctcagacgtcaacatacagaaaacagggccgaggtgatctcgtaaaccgatctccccccccattgtgaacgatagcgatatccatagttccggcaaatattttctcatttgttgcattggctgacgccttcactacgtgtcgccaatttcacgaaatgagagccaggcattaggttgggggatctcttccaggacagcgagcagcgcggatccctgcgctcgatgtgccaggagccatggggcctgggctcgcactcgcagctcgacatatcatgtgcattcgccacgctggaccgagctcaagtcctgagccactgctctccagatcccatgtgccagctgctcagagtagaatgattgccagccatggggtaggcgactttcttcatacgtacagcgtagcacccggccaagtcgatcttgattcgaggcctcgtataacgtgctactgtgcgcgtacgtaccttggatataatattgatactagcagagctgtccccactcacctcccatcaacggtcctgcatccttttcgccaaccccggaatgacaagtggaataaggacaaaagcaaacaaacagacacgcaccaagacgcgccaacagcttgtagcatcacatgtaagctgcgctaccaaaggaccatccatccgcaatggcttaggggcgtaatactgcctctctttctacacactccatattatgtgtgcccatacacaggcaaaacatgcagagctgccaacgtgcatatggaatcttggccattggagcatccagtttcagtccctcaccggattctggagcccagtttcatcttccaccgagaatgggtaaatcccccaaggcggcagctagaccactggtggattaatcagtgcgcgacacactttgactggctccctccccacccttcccttcatttcgtttgatccggcccggggggttctctccagaggggaaaaaaaagagcagggccagggcagcgcatggcacagcgagaaaggaaatcagtcaatctcgcataatgtctgcatatcagggggcggatgcgacacactctcaggtaggtagtagtgctgagctcgcgggaccgtcgcgctcactcagccttactgtcaaggcgagcacgctcagctcgtcgttgagcgtttagagcttactcaggcgagatcctctcacatggctccccccaaaccgagccacgcagttggagtctcatgtaccaagatagtgtcgggtatcgacgacaccacgtcacagggagccaggtccagcctcgcctcagatcctcagccaagttttggtgcgtgtcagcttcgacgttggcttctggtcgtttgggaacgacaccagcaccgcactaatggctggctagcctctagagctgccgggatctgctttgcagcaggaattgaggatgcacgtcttcgcgcggcatcaggcccagccatcgtgagcacagactgccgtcgcgagccttgatttcgatccaactcattgcgtatttagtaggctgcattattaaaacaatgcaaatgctgcccccaaatacaaaacatagtctcactaatgattcaatggcggggtgtcctctactgcaccaggctgtgaacgcagccaacgaaagaaccatactattgggtacacacgtgaaatatgatgcggcttgttaatttctcgggcccaatcagggcatacaaaaattgggtgtctgagtaatatcgccaaccaagtcccaactgagcattactattactactacttccaagtttccaccattcgctggaacggggctgcccgtcaaggaagatagcccggggatacttccggtttttgtggtcgttgcttttcacgctctgtcacgatttcggcttccccagtgagcctgcttccctccgctacgccgccgatcaaaacatcgtgagagcttgatctcgtcgttcaatggggtaggatcgtgtaatttcttatcgggcaataaattgccttcatcggcttaacctcgaatatattgccttaaccgtaagcaggtactgttactacctacctaacagggtagtgagaggtagtatcgagtttgaagcacccaggcggccgcatcgcgcctcatctcaactgtcccctcagggcagaagcattatggggtttgcagattgacagggggcccactgaagatacttacctacgtacatcgtcaccaaccaacttatgcggtcttattgacccagaatccggtgatgcaggtcgcccaccgaggatgatattggatgatcagcacctgatattgatgatgcctacatccaaaggtccttgacctgctagctacctactgtgtgttggtgattttgtacgtcacccctgtaggccatgcgttggtggtcgtgtgcgtgaatcagatcagtggaacgaggagcgaggttcgtgagatagagcgccggtccctgtctggtctgaagtctcaaaagtgcaggcaggcagaactgagaaggagctctccgttctcgcccctctcgccccttcccctcctgcgcgggtgcataggtgcaggcaggtacggtgcagacaggtgggcagctgcaggtaggtgcgggtgcttcagtggttcctgtcctggcttgtcctgtcctgtcctggtggtgtgccagacttactgcactcaacccgacctccatgtcgcgatccctgcttctgcccctgtttgatccatcctggcgtgcccaccaccgcgtgcatgcaccacctcccgccgtctttcccagccagctgggcggagtctcagagcgaccgcagagggccgtccacttccgaggcctgtgcggcctgttctagcctgctatgttcttctattccggtgacttcatgcgagcttaggcttttacctttgctcacctaattgttttcgacctcctttatcatccttcccctcctttttttttgcttgtcttttgctatccccgactactcgcctgataccacagcttgtggtgatagtcgagaccacgaccgacggcactaataatactcacgacaccagacgggcgttagaggggctcccgctggacaccaggctctaccgacgacaactttgattgaggacggatgatggttatttcacccaagacaactcttgccgacaactagctccaccttcgactactctcgctttgaatacgcattccgttcttttcatatggggggcattgcgccagggtcgaccagctggtcaggtcaagctccccaagcctccccgctcgttctcttacagctcctcatctagtcgtcgcaagccgatatgtcgacgacaacatcttgcggcgccatgccccgacacggctccgcttcccacattctctacctatttgtcttcgccggcttgaccagtcatgtctacgctctgccttccggatctagtcgggtggtattgagtgaaaggtgtgtatttgtgagccaaactagcggttttcaacatgtattaacatattttgacctaggacgactgctgaattgcaagccgatgggtttactcttattccaagagccgaatccgagggaacactctccaaaggtgccgctgctggtatcgttgttggtgtaattgtggctggttccattgttctctcggccgtttggttctggcttcggaggaagaaatcaagtcctgaaaccgaaacccacgtggttcaagaaaatgaacgtggacttgaacctgtgcatgaaaatgacactgactcggaaaagctctcaacaacctctttaacagatgctacaattaccactcctccaagtcgatcgggactttctcgtatcatgagcaaggtggctcccgcgcgagtaagcagtcagccgaaaaatcaaagtatcgacaagacggtaccgattgaggcccccgacaatgaggttttcgagctagccgcttgtcgacctcctgctgagcttgacgccgacacgggaggttctgacgatttctggatcgtcgatcatgaggttggatttgggttggatgaggcttatcccctcagcccgtatgagcagacgaggctcaagatggaccgccaactggcaggacctgttcctgcgtatacgccaggcgattgggctcaaattgcactagaaaagaagggacaagacgatgccaaagacggctacgaaggcgagcaacaggaatcattccctaaccgaaatagccctgagatgaggagatcatcatctaacgcctgtgtcgacccatctccgctctcttcacacaacacctggtctacccatatctcgcaagtggtgtccccaatgaccatggtgacctctgtggtcactcctaaattccctcctactgctcttacaagaggcaattcaagcggtacttatcgcgagcgttccctcgagcttaatctcacgactcgatcaaactctgttcccaactcttcatcaagcgaacggggttcctctcgagtccaacgaacacctattaaccctaccgaggtggtttgtctcggccccatccccgagaatatcatgctacccggacaaagccctaggccggagatggatgggcccgaaggcttcaatctcgtattaccaacctttcaaccttcagatgacccagcagaagacacactgggaagtaatttcacaattgaggaggaggcccggatagcggaggtattggaaaccgtcagaactgcaacacaagccgaactgtcgcaaaaactccagtctagatggtctagcgccaataagggaacttcgattcaagcctcgcaacaatcacctccgctcccggcaatggtagcagaatcagagtctgcgtcgccaactacaatggaggaggagccgatacgaaaagaccggatcgacccagcactagatttgattcatgttccgcaaattcccaatcagcgatatagttgggaaggcagcactccccattgattctttacataagtttattaccgattctcgcccatttcgacgttctttcactctataataatttcacccgtgcgacatatacgcacatgtatacacccacgcgactttagctctacttctccccccctggacgcaatcgctgaggggctatgatttaatgggccattcgatatttcctacatgtctggagatcctggattggatatgatttgaggtacaatataaaacaaaaggtgttatggatggataacagccaacgtgtcaaatgctaatgccggattggaatgtgatttcagggagaccgcctgacacggacacagagttttcaggtctcctccccttctttataccaaacactcacaaacaaacacacaaacacactccttccctttcctttaacttcgaacaactgctataccagagaatttatttacatgttatattgttgagcatctcccaaaatgggtgagatgagtggatactgttttctccctcgttcttttactaagaagcccggcgttttggtccaagcggcgtctggcctgtactcgatggttagagttgctctttctacatagatatttcgttggttcgaagattggctaccatcgtattaatatgctgaaacaatactttgcaattgagattatatttcatcactacgggatatcctggtctatggcctttcctctattctatcattggcgtgacagagccacttgggcaatcatctgcccgggaatgtcgtagcataggtatggatcaaacgccagctaccaaatctcctgccaccaagtcaatgattcgagctgcttctcccggtctggctcttcaccgctcctcctgaacgagtcgaagacggtctccttgcaggcatcggccatctttgtagagccaccgcagatggagaagatggcattcctggggatgagggcgttgacggtgtcggcctcccgccggaggatgtcctggatgtagaccttatccggctggtccctggaaaaagcggtgaaaacagtcagggtcgcattctcgtcaccaccaccaccaccaccattgccatccttgctcagatcatcccactccttctcgaagaagaagtccttggagcggttccggtttccgaagaagaggagcatgggtcccgggttggggtgggtgagccgctcgtggatgaggcacctcacgggggcgaggccggtgcccgtggccatggcgacgagcgggcgctgggcgttgtgggcgccgtggatgggcgtgaggactggcttgtagccgacgcgcatgctggcgttggggggaagggaggcgaggtagcgggagcagaggccttggcgaggtttgcggaggatggtgcggtagcggacgagggcgacgaggagctctacgcgggtgatgctatcgtcgccggtggggtgggcgaggagggctcccccgttggcgatgctgaagtcgcggccgcggatgagggggaagacgtcaaggaggcgttctggggggatcttgactgaggtgaattcatcgagaacttcgaggatcgttcgccgagagcgggtagcgtagtcaaagtactcgtcgaggaactcggttttggtgaactcgagtagtctctctttgtgattagggtcagtcgcgaaataggacatgctcttgaagaaagaacggcgagggatcgaggtgaagtctatgttctcgaggaggagctgacgaatggtacacggttgagaggcgtggagatttcgtgggagggagggacaagccgaaaggtcgatttgctggtcagcgacagactcccagctcataagagtgatcaacttttgaacatcctcggggaagttcttgggataaattgtcaaacaatcgccgggattgcacgccagtttctggccggcagcacgggaagggacgtcgaagccgagaagcctaacatcctgccagtgggagagcggcgtcatacgtttgctctcagcaagggtagcttcccacccatctggtatcgggagaggccctggaggtggtacgtctatgtccgaatgtgaaataattttggccgagtcggtgctgctgcggctcaacgcaggcgaaagcgaccactttggtggtaatatagaatcatcggatatgggagcccggccagccggaggaggatactcctctagtagatgatcataaaacttgccggcccaagatgagaaagcgccttctatcctggagcttattgtcagctgccatgctttcacgcgtagcctccttttcactcacccgtcgtcaaagcgctcgtcagcctcgaagcagtcgaaaaatgtgttcgcacccagttgttcaagtcgacgaataagcttgcgagctgcccaattaaacctaggaggggggggggggcatgtaagcatagtgaagcagtataaagcaacgtcgttcttcttactttaagtatgtgctatctccaaggccgaagcaggtataccggacttgacttagacaaccgggaggcagcttcttccgcaagagttttctccagaagagtagagagttatggggcatatccccttgcccagtggttgagatgacgaatatgacaagctgatgctgtaaaagtgaattctacccggcgatgtcatgttaacagctgttatcaaagggatcaattccgagcaactgaccagatcagcagcgtctagctcctctacgtggcttttgaaatgtaggcgctgacataggctgcccagttcttcagctatgtcttgggaatttccagtctcggatccatataggatcaagatgctcctccccggtgaagccatgacggttgtggtactcagaggcttcggtacagtcaaaggctggctttgacccagactcggaagccttttgggctaaagcggggcgggcgagcaagactggaaatcaattgaacgagttcaaaactcctcccggaggccgtgaagtggaagttcaagcggtatttgggcgagtgaagattgaaaaattgtgggcattgatagatgccgatgacggggcgttgttcctagtgcaaatagcctactccgaggtaggcacttactagatcgagcatcttatcaatcttcagcctggggtcgggtccaaggcttgaaattcacattcttgcggattccaggaatgggacttttacaaggtttggcgaatgagtttgcagtgggcttttaatgtgtgggactggtcatttctgtattgctgaaacctcctttcaaagggtgccaagataggtatatatgttctggtgatacctggcgtccacagttctcggtttgtgttgcttggtcagtttgcagtgctatatttttttttggcgttaggaaatcaatcaactgcctacgcgccgtctcttttcgccattgagccaaggttccaggggagggggattcggaaaatagagaatagaagccgttggccgtagatcgatatgcactgtcggagagaggctgtacgttgattccaaaatgccacccatcaaatgggtttctacataaagctggacaagagctccttcttgcttcacaacaagcggggctggggctctgtaggtgcacttgccgacggacatttcctgtggcgccttgggaattaattgctttgtctcggtacgggaaggaacaggagggctactaaatgccttgggaggcctggatgtctttggcttcaaagtaaaacaacaggtagcgcagccctgagcaggcacctgctcctgccacatcgaaggcaataatatccgagaggccaccaccttccgtgcaccacctgaaattagagttccgctccgcttatattgcgaagcatgtgaggaggcttcgcttctggtttgtcccttctccttgttctccatgtcgtgtcagtcctccctgaagacgagcctggacactagacgacacccatgcattctcttccgtggactggggaagccggaggtcaggcagtattgcagaccgggtccaccgctggactgaggcatgcgtctcctgcaagacaacatcatcaggggccctggaatctccgatctacccaataagttcaacgtagtgcctgccagtgcggagtgagtcattgcggtgtgcagaacaacactgtaggagggtgagtgcccttgcagctagcgcgactgttctcgcagcttctgtctgaaccacggtgtatagagttgcggtgatcaatggccacccacttggcacttgcggcctccgctcgctccgtgcttgcctcttcgtccactgcccgccattcctgcaccgtgccccagctcggcaagtccaaaacaacagatccaaaagcgcaatttgcggccatcggtcaatccttcctcctttaatgggttcccgtcggtccgcttacgtgaccctgtctcacttttctgttgtagctcagtgttatgcgcaggagtaagctgcgatgtggttgtagcttcctgctggggacaaggcgggaaggtacacctcagccaaggtttggggcggccagctccctttgagtcgcgtgtacctattattaccctggcctggatgctcctgcgcctggaacaacacctaattagcccccccctgccacaattacctgcagcaacgctcgctaggtgcctcgccgtagtggccgccaccgccccctggctctggccttattaccaaacatacctagagcagaggtaggcaggagcaaaggccagcatgcccaaaaaaatatttcatatgtcgcgacactcccagctccctttctccttttccccttctcatcacaatactccagtcaactagtgtctccgcgcaacgcatcgtcgtctgtctaatctcaacccgtacctagggcaccaagccaccctgaccaacactcctccttattgctccaagtgttcgattccccgaacttcaaccacaagctatcactttcgaacgttactgcacccttaggctggtccacaagttcgaaacgtcatccttcacgacagtcctctacacacttcaaacccgccatcatgtctgctgcccctgtggagaaggtccccgagaccgctaatgttaatgacgttacaaatgctctgagcaatacctctctcaatgataaggccgccgcaaacgaggctgcttcggctagcgctgccgaaggccgccgtctgtatatcggcaacttggcctacgcgacaactgagggggagttgaaggacttcttcaaggactatcttgtgtatgtggccactcctgactgggttcctttcgtcgagttcttggcaacgctgtgatgggacattgggagaggacttggttgcaaacagtttggccaagtcgaggctttcgtggttgcaccaacttttgcaatctcgcatcccttgacctttccctcgttctcattcagctcgccttttacttctcacgctactcatccccagtcttattttccagtatatgctaacttgtaatttgttagtgagtccgtgtcaatcccgaagaacccacgcaccgaccgtcctgttggctacgcctttgtcgacctctctacccctactgaggccgagcgtgctatcgaggccctctctggcaaggagatccttgaacgcaaggtttccgttcagcttgctcgcaagcccgagccagctggcgagaagactgaggcagccaacggtgaaggttctggtggtgagggcactcgccgtcgcgcctctggacgaggccgaggccggggccgtggtcgcaacggacgaggcgcccgcgctgcccgtggcgtaagtgtttgatggaatttcgcccgcccatgctcttttctgacattctctgtaggacggtgagaagaaggaaggtgagactactgaggctgccgctcctgcctctggagagacccctgccgctcccgcagctgctgccactgagtctaagcctctggccgatgtgaccaaccaggatgtctctgctggcgatgatgctaaggcccagcgcgcccgccgtgagcgtggcccccctgccgatggtattccctctaagatcaaggtcatggtcgctaacctgccctatgacttgactgaggagaaggttcgtttctacggcagatttttatattctgtgcattgtactgactagatacagcttatcgagctgttcaaggactaccagccttcctcggctaagattgccctccgacctatcccccgtttcatgatcaagaagcttcaggcccgtggcgaggcccgcaagggacgtggattcggtttcgttactttggcttctgaggagctgcagcagaaggctgttgctgagatgaacggcaaggaggttgagggacgtgagatcgccgtcaaggtcgccattgactctcccgacaagaccgacgaggaggccaatgcccctgctgacgccgatgtcaacggaaaggaggagaagaaggctgatgctcctgctgttgccgctgcccccgcagccaccgaggctgcccctgcctccactcccgccactactgcttaaatgcaggtggcaaaagggtgttgtactccaccttgaatgagtacattacgatatggtacgcgattttgacgaatttttcttacagtagatgttatctacagcaatcctcgagaaggcgcctggctctcggtgagccgacggttgagaattctcgaccgggcctctctggactattgaaaatcttgggatgggtgttgatgccgccttctttttaacacttggcaacgctctattttcatgcactgggaccataatatactgggaatcagacaaggaatcaaaagttttgaagctggggctcaaatttcgtgtatccatatcaaagtttttccattttcacttgcggtcgctttctgctgggttatgtatgcgttagcttgagcatggagtgatcgggtgggaatatctaatgaaaacaatagcgctatggttgtgctgcctacctaacttaatgcaaaccaatagacctaattatgcttgagagcgcttgtccttcactgtctgattgcttaaagaagaggttctagcccttcttgaattccgcttgatgtagaaaacacggttttgcccgccgtcgcctgggcccttggagccatctttgatataaaatgactagttgaagttcggtttgatcaacgcaagcggaactcccatctaaagggagataactagttgaaaaggcatgatttacgggtgaggagttcaatggcggcaacgtccgagcaaaggactggcagctgtgttcagcttgcgtgatgtggttatcctatttcgaccattctagcaattcaagatgaggcggaaaaactatttacaatttacatatctggttgaaaccaaactagatcagtaaaggaaagaagacaagactatgtctgtagatgcgttcgatagcaactgcacttattctggaacttggcgtttccccctgctcttcaagactatgtgtcaggggtcgctgaggagttcttcgtgtgtgcaaaccatcaaaaggaaaggctggatcaactgaaacatctagaaggaacatttttggggttacatgtgacatagggagccaccgtggcacagttgcagttcttcaattatacgcatgtaggtatttcacaatttccccaaacattaccgaacatggatatgatgatagcctgcaggttgatcgtaacaagagcactgttattgctgctatcaatcaacgcctcgttgggtgtctgatgttctattactttgaatgttgaccattttcttgccttggtttttattttgacagtgcttcaacgtgcgtgaatctttaggtatcgaacacgttagagcctctcctcctctctcaattctggctcaaattctagaagggttggtcaaagtctggtgcctcattggtattagaacgtaccacgacggtgtgatccgttggtgtggattgaggtttttagagagaagaagaagggtaagtattagctgaaagaagcatcgagacctctttcaagttattcgtatactgaaatttggtatttgaaagagtatatcccatggtatgggtatgctatatgccaatggcctgtctctgtcccctatgttttgagtggaagcgtcatggtatcagtagtatgacaggtcgataagtaacagcagcttatcggtccactgatgaggcgaccagtcagtcgatgattgggtgaccaaagtgctgtaattacatacctaggcacagtagtgatctcttaattctaatgtattatatctaaataatatgtccaaaaatttgctaattggcgaaccatatctccatgtataataatagctaagattagggggtggagagtgcgaaatgggctcaggtggtgttctgcgctggggacagtgttaactgtctggaggtaggtcctccctcagtgggggaggtctcgggggtctggattgttttggcccctggaggatttgctttgagacgacacactctcccgcttaggctatctcatcaccgctgcaggctctcttcttttgctaggcatttgctttcctttgcaccttctctctctattagcacagccagagacggccttccatatcacaatggcgtccaaggccatgtgggaggtagacccagagaccaggtccaaggtaggttgctcgtacctagaattcccacatgctctggtcccttgtctttgctaacgcccagtctctgtgtccccccttacgcagctggctgctcttcaaaaggaatcgaacaacaatgtttgttgcgactgcggtgcgccctcaccgcaatgggcatcccccaagtttggcatcttcatttgcctcacgtgcgccggcaagcaccgtggcctcggtgtacacatctcctttgttcgaagtgtctccatggacgccttcaagtcggttgaaatcgagcgaatgcgacttggcggaaaccaaggctggcaggaattctacgaagcgcaggccgactcgaaagtcacctgggacgcgggcaccgagtccgatcggtatacgggagagattggcgaggagtggaaggagaggttgacgtgcaaggtggagggcaaggagtacgtcccaggggagaagaagccagctcccgcgccaaagccagcctcgaggcaacccatgtcgcccttgagcggaactgcgaaccggagcgagagcccagctcagggcggcggaaaggtaagggtggacgaccagtactttgcgagattgggtgcagacaacgcctcgcggccagaccacctacatccaagccaaggaggcaaatatgcaggctttggcaacacacctgggcctggtccccaaagccccgatataatgccaacgttcgacgacgtgcaaaaggatccggtcgcggctctgacaaagggctttgggtggttcacgacaaccgtctctaatacagcaaaaactgtcaatgacggctacatccagcctgccgcaaagaacgtacgtctcaacttctccgacttcttcgtttcactattgcccttcatgctaacttgccaatgcgaattcagtttgcagagggggatttcgccaaacaggcccaacttaccgcggcgcagctggcgaagcaagcccagatggcagggaagaacgcacaggaaggatttaaccgctttgtcgagggaggtcaggagcagcagggcactagagctcctctcatggatgaaagcaagaagacattctgggacgatttctccaacctggcagagcagaagaagcagaacagcagcgccattggaacaagcgcaatgggaatgggaaaaaatagagcggcggcagcgccacagactaagaagcaaggggacgattgggacgactggtgagctcggaaatagaggctgtcgaggggggcattgggtcttatactgataaggagcatcggcgtttacatcactgagagatgcagttttgagatgccttatttgacaatgctagcgatttactagcttaccgtgtttcttgatttgagagctcttattgctagccatggcttgagacaatgttatggtcaatagagagaggtggtgcgttggaaatgaggccacgcatgtttgtactcgggtgacatgttgtggtaagccgcgtttgcctatctttctctcgtctactaagccgggcaagaccactgagtccgagttcacatgctacttcgcctttatggacttgtgcgtttgcccctggcaaccttaccaaatattgagtgtgggaatgctggatttcgaattccgacctccggaggctacgtcacgtgcccgaatgtcccgaggtctgaagccgggagtaaccgccccgagtcgccgcaatagtatcgccaaagcccaagtagccggcttctttgatacttaaccacgccggagtccaactgcaggtggtgaattaaagacgcaattcaatcacaatgtccgcgctacgcatcctcgttcccgtcaagcgggtcattgactatgctgtacggtcctctcccctccaatacgtttttttttctacaaagctaaccgggcttgaatttcgctaggtcaaaccccgaatcaacaaggcgatgaccggcgtggagaccgtcggcgtcaagcactcgatgaaccccttcgacgagctctcggtcgaggagtcggtccgcatccgcaaggagaaccgcgcgccgggcggcgtcgaggacatcgtcaccatctctgccggccccgccaaggcccaggacgtgatccgcacggcgctcgccatgggcatcgaccggggcatccacgtggagctcaaggagggcgaggagctggagccgctgacggtggccaagctgctcaaggcgacggtggaggcggagaagagcaacttcgtgctgctgggcaagcagagcatcgacgacgacgcggggcagacgggccagatgctggcggggctgctgggctggccgcaggcgacgcaggcgagcaaggtggagtttggcgagggcgactcggtgacggtcacgaaggagattgacggcggcgtggagacggtcaaggcgaagctgccgatgatcgtgacgacggacctgcggctcaacacgccccggttcgccaagctgcccgacatcatgaaggcgaagaagaagaagctcgacaagaagacgctggctgactttgggcttacgagcgacaagaggctcaagatcttgaaggttactggtgagttgcagctttccccttcctcctcatcacagctatagaacccttccattttgcttctgtgctgaggcaatggtgccgtgaattttgttggctaacttgtgtgcctagaaccccccgtgagacaaggcggaggcaaggttgaggatgttggtggtcttgttagcaagctgaaggaacttggtgctctgtaggcggcaagttaaaagatggaatctctttcgggtataattagaccgattaacgaatgaaaagacagcaatgaacaaatgcaaatgctacgctttgcgtgaagaattgaccatccagagctccggagtcggcactggttgctttatttgattccaagctttatggtgcacggtcaacatcatggtcaacactgggtcacacttttgattatcgtttgttcgattccattgtccagtaccgtcatcatgatgtgtaggattcgtcacatgaggcagctccttgctcttgccgttggggcccaaaccgtcaagatgaagtatggcaatcgagctcataatatcccgtccctcgaccttaccaccggactgtgtcatattgtaagttcatcttgtgattcagtttgcgtagttatattaatgtttattgccagacctcccagctacagtgtgaattccgcaactcttcccagcgatttcaaggagtacttcgtaagccaatatgcccaaaatttgaatacaggcgaggaaactgaacgatttatgcttaggtaaatctcaatgatgggagcaacgagggtatgatgcacaagacccgccccatctcctccacccagttccaccccgaggccaagggtggcccaatggacagcgcctacctcttcgataagtacctgcagaacgtccagcgcgagaaagaaagccaggccgtctacaaggacaaccgacccagccagtttctgcttgacattctcagccgtgaacgcgtcggcgttgagccctctcctctcgctcaggcggcataagtcacaaaattcaactttaagttcgggagattgctcatagggatttacgagagaggagatgaataattttgcatttgagtgtataagaatgtgtggaatagcgtttagggaggcgatcaagtcttgatttttaccgtaattcaaatgaaactatttggaaatacgagaatatttctgtgtatgtgtggctgatctgatgtatggtataaaattgcaattgcatttcaattctatcttggaaccatcaagttcccttcgtacattaaaaaggggctatctacccggatgccgtgctggtgctcctccttgcttcgagcacgcaggccatttaatcccatagaacctttgcccattcatgatcattaaataccacgtggctttgtaatatcacactgtaactccatttgtcccgagtcatgcccccttttccattaaaggcccatgtgagaatggcactccctttttcagaagtgccctggcaggtgttggctagctccttaccataccttggtgtatgtaagtgaagttgaaagaaaatagacgataagagccgatatttacgtcggcgtctatcgatatgtctgtgacgtgcgattctcctatctgtaatcgcgacgaggagggcggtcgtcacgaccaccagcaccaccggggaggtatctatccccgcctcttctgtgtgggggcggtcctcctcttcgtcctccaaaccctcctccgccaaaccctcctccacgaggtcctgcgcgggatcctcctcgcgtggggcgatcgcgttcgcgatgggggggccggatgccctcgaagacctccttaccccggtcgacgaagccgtctccatcttcaaacgagtatcggttgaagtcacggccgagatcgcgacggtcgacatcacgcttatagaagctgcgcatgttatccaggcgccgacgggcgagatcttccgatactggagtgtagcctatgactggctgggcctgtgtccgctttgcgtcgaacatgcctcccgccatatgtccaggtggagggcgcgggccagggccggagcgcttgctacggggtcccgtgggtgcgttgcttatgctcaggtctctctgcgaccgtgggccgacggggatgttgttcgcgctgtcggcggacacggggggtgcgaacctgccaccggctgctgatggggcggggggaggtccggctcgtgggcctgtagctgaggcagcttccaggcgagcctcggtattcccgttggcgtcgtccgagtagacgacttcccagcgggtggacgagcggccgccctggccagattccttctcgatccaagctggtaccttctcgggcgggatgaagtctacccatagcgctttgcgattactctcgttgggccagacgcaatcgtggagaaggttccgtactcgggacgccgctggtagattgtcgaagacgacgaatgcgtggctgcggacctggtcaatgtggaattcagtgatgatatcgtcgttggggggttgaccagcaggagtggcaaggtcggcaaggtgggtttgaatatcaactgggcggagcggtcgcatcaggttggaaatgtacagcgccgtagtggcggggtgcacagatggcggcacatctcgctcagagccagccttgtttcctgtagagcctccaataggctgtcctagcttgttctgggtctgcacgccttccatgctatcaccagtggcctcttctgcttggttttcgggctgagcctgcttggaaatcgctgcgccagttgatgtgttgatcatttcactctggagagtacgtgctcgcttggcaacagcttccgcgtcgggggttggggtagcagagcgacgtttgcgcttctgcgactcggcttcggtgggaggcggatcgttcgataaagtttcggtaggctctcgtccagtctcggatgtgacaataatctcgtcttgctggttctctgccggcttctcctcggaattgttggagggctcttgactgaggccatcaggcatttccttatccgcggaaggtgctctcgcttcggtgctcggttcaggcgaggtttgaggcagctcttcgctaagcacagacccttttaaatcttctgtgtttttgttttctggttcaaaatctcgcacttcgacgtctttctctgaactgggtttaatttcgggcggtgcttggactgatatcgtatcagaggacgctgtaccgtctggtgtttcagctccatccttgcctaggccttcggacgagtcaccctgcgcaccttgtccatcttttccttcttcctcgttgctggcttcgggcgcggcctcgctctggtcggcctcgacgaggcgcgcgaccagctcagccttcaggccatgttgtgggaggtcgcggcgcttgagctctgctttgagatcaacgaccttgagtttcgcccagtcggccatagtacggccaattgatcccctcggaccacgttctggtgtcggtctttagccagtctctgggggtggattggcgagttcgagtctatgcgaaaggagctatgggatgggctgtggtctggatggacggcgcggctagccacgggatgggaattcgcgagagcaagaaggttattcgtgcacctgtgcacttgtccaggggccgagtccgcagcggcgatcgagcagacagatggtgatgcaggtagcaaggttgtcgaggctgctgcagcatcaattcatgatacccgagttagttccagcccgcgtgcgcgtgtgtcgcgagccaaaggagaaaagcgactggccaacaaatgcaggcccaccagcccactaagcctgttctagggcctgaggtcgattgattgtgtggcgagtggagcaagatcaccagtttggcccacgcacttagaaacaggaggccggttgcctgcatggaagtaccctgctagtgcctatgacaaagctatgtggcgcttccattttgatcctagcgccctcgccgctcttgctcagcaacccgctcagtcgcgccgcgaatcgcttcagtcacgtgattgagtacctccaccggcctgagttatacacacatattatacaaacagaacggtctagactgcttaccgttagggccactttctccggttttcgcattgtacacaacagagctgaggagcatcagtacttaactggaaatgtccgctggttccaatcatggaccagcaggtaagagttaacaaaaagtaaagccagtggctgtaagtatgtagaaggagtaggtattgttgaaccgaggcatcatggaggtcaggttttattggaacggaccatgcagtcaattgaaagattctgtgtattctatcttgaccccctctttttcagctgtgcaaagagtcctccatctgtaattatctgtattttatatatttatagctagtatagttatataatatctcttacttatataataagatatattttaactaattaagccttatcttattaatagaagacttatcctttataacaccttagtttgatatatccctagttttaatatcggacgcctaattaaatataatatattagagttaatgtcttgacaagaagtgcaagctaggcagaagatgcccacgatctttatacctcaagctttgcagcctcaaatttgggaatagaactacatctaactgatcaagctactcgagcatatggaagtgtaagaaacgaaacatatgttcaacactacggcactcctctccactcggttcccagtatagcaacctcatcccaggacccggagggccgcataggaaaggcagggtttaagaataggagcagcacaagaaacaggaaaagtcaattagatttgacatggaagagtagctttcttgtaagtgttttgtgccagaaaacttcgaccttgctaacatcagctcgcctgtctctccatctcctcccttcgtcgactacactatgataggcaactttaaaacccacgtaatcataccttcacgatcgggacctgcataggagatattgatatattatatagtttagaaactcgcaatcttcaatctcttccttgctcaacgccaaggctagacttgcggttggaactgtttggaatctcgcaaggtagagagggaggagcaagaaggtctcccgacaccggccatcataccaagtcgtagattgttcgttttgcatattgcatactaattcaacgaacatgcttccctatccctatgatgcaaactcttccagttgcggccattccttttgcaccctctgtgctgatgctacctgacgtgcattcccttcgttcttagcccgctcaagtacacgatataatttcttggtgaagatagcgggagtggcttcctgagctattgaaatttgggaatcagcagaggactcgctcaaactctggtcatccaacatcattggaacgtccctggccttgtcactagcctgggaggaggaagtttcttgctgtggtccaggtgaaataactaagtgtaagaacaggtcagcactcttcattaatattcatccatcatgtttttacctttcccagcagcatcgaccattttgtgtgaatagaaaggcccacatccattactgctgcagcaaaggtattcttccagattggttggcccccaattcttaggggcgtaaagagtattctccaagtagcccggtcccgtctggagagcaaaatagtatgttttcggaaggatgacggctacttctccctctttctgcaccatgagagagatctgtattccatggcttttaagaaaatcaagtgtcggaataatttttcggtgtgtaatccactgcgtgcattgcgctttatctgaaatcgcctccttgattcttctctcaagtttttcggtgcaggtcggatggataacgacgtatattttgggagccccctggtcgtgatagtagatccatcccagattccatggagccttttgaagtgggacgaatgcttgccccggcatcagccatgagaaggtgccgtcaaagcttttgtctgctctatacttgctatgcaaacgatcttgttgcttgagtgaaaaggtggccgtatcactagtcctctctagtatccgctgtgtgtgagtgtgaggaggtgcacaaacttccttgagtgctttttccaattccttttctgcgcagatttggttgttgccactcgcggccgcctcgaattttacttccccttgccctatcgatatctcttcttctatcatatttgagtgaagcaagacttgagagcttgaaggatgtagctcgagggattgcaatgggcccctctcgaattccgaataatcaagttccattggctctcgaccgtatttgtgattgagatggaggaggagcgctccctcttcacagtcagtggtcaaactgtctacccgctcgctgcatatacttgtaatgtcattagggttaattatgtcaactgcatcaggtacggcttcaattttggaatatccgttcgccatcgtcaactggagtgatgcggagccgtgtagctccagttggtccgtctaggagattaagatatcaaatagaaggtgagttcatgaattgcgttcctctgtacagctttgaaggatcttggtagaggaggaatagggagatcgaagtcacgaaaaaaaagagctaaaaaatctctcttctggagcagagacgaagaagagggggttacagcgctggttgctggtgcctaataacaactgagaggccgcccgccatggcggcatgcaagattggttggtcacagagagaaggttgagaaacgcccatggcgtgagacctgcatgagcaaccaaccaatcaactgcttaacgcaatgtcagccaaccgatgcaagttccctccatacttttaagcatagtctgatggaaaagaagaaaggatatgcatagtatgtatgtatggtaagaaacagatggtaaactgggagtgttcaacggcgttgccactctgtaaaccatgctatttccagagtttctagagggttcatcatccaggccagtgaagcccccttgattgaaaaagatacggctccagggaaatgatgaaaccagatggtttgtgctgggagcatctttaggaaatagcaagtcacagttcttgtcttcttagatgaagtgaaatctccagagccagatttcaatcgggtcaacgtttgagagatctttatatgaattaagcatgacttccccggaagtttggtggagtattacaaaaacggacctcactgcgtgaaaccggcacaccaggattcgaaattagcattctgccgactgggtaccgtattttgcggtcagcgtttggaaagcggtacattgctattgcacatttttgtgcaggtgacatgctcagtcaactcaggctgagcagggtagagctctgtctaaaagcggcgctgctcaggaaactgccgacaccaggatgcactgtcacgggatgtattcagctagtaccctgagctgtttgatggcgaaaggttaccgccagaagcgcctggatatacatgcacgctaccgcctcacctcatcacgcaccatcttgatctccggaatagcgaatgaaatactccgaaagcaacattccccaccatcttctgtttcagtaagctctcttgtgctcccaaactacatgtcgcaggtacagctttcactgcgatgctattgaacgatgcgacgtaacagtaaccagccaggcgtttatgagggaaaaattttcaattgaggccaacacggcggcacaaggagaaaagatgaatttggcgagcttgaaaagggaattgattaaaaaaaaaaacagcatgacattcgatttcattcgttaaaagtagctaggttatatggttttacaagtttgggttttggatattaatattgtcacacacgtaccagctcacatggcgcctgatgggggccatatatatagagcggcacaactggcactcgtctgccgggcttaaacgtcgagaccatcaacgacgatgcccttgttccaggaccactgcatgatcctggccacctccaccgcacattcatcatcaaccatagcgctgacaaggtacaaagctgcgtcaatgccagcgctgtttcccccagacgtgatgacccggagcccgccaaggcgcatggctgcgcggcgaacaatggattcacggcgggagttcgagcccttgaaagaggtgctaccctttctatgatggaattagtattgtacacgtagtaattagattgcattgagattggggcttaccgggcattcgatggtcgccgtccattgtcgacactcttgcgacggatgtatggattctcatcctcgtcacccaagtcgaatctgagattgttgacaacatagcgagcgtcctcaatgacgtcagttcgctcttggaggttgcgagtagcagcgtcactgcagatattctcgaacttggttatataatcggggtgggttgtggcagcgaggccagagaggataccctcgcgggcgaggaagagagagccggtgcaaatggagaggatggttcgctccctggcgggatccttcttctgcagctcagagaagtcattgatgaggccgaggggttcggcttccttcgcaaggatctcctcggagttgcctccaaggatgatgaggatgtcaaagtcttcaagacgttcgtgggcatccttgaaggtgatttgggagtcaaccacgacgccctggtcggagagcaccttgggctccgcaccagcaacggtgatttcaaatgcattggagcctgggaggtagcaagtgatcagtctcagagtcgtcttggatggcagagacacggcgatagaagttcaattgggctagcaagaaaggaattgtggtaacttactgctatccttgaaatcatggagagcgttcttgaggacctcgactgggccggcgagatcgaggaggtcaaacttattctgcagtgcgatgaggacgtccactggctcctgctccgcaacagcagaggtcttatgcacactcatcttgacggtagtatggggtggtgtcttttaaagacgggggggatgataaaagtgatggttggtgggtggattgatgcttctttgatgatagcgaagaagggaaaaaagctgaggaaggagggagggaggaggagaggtagaagtagtagctgagggtgaggggtagtgagcagaatgaaaaggattggagcttgccagatcagatcacgcgacgatgggatgcaagcctcctcctctacatactacgtctctgtggctgcaaagtacctgaagcaagggccaggttgctcccaagggaaccaacccctctccaaccttcaaaggtgactggacggtgacaacatgcctaacccaggatggagagcatctgcgtcggcaccggattcaagagtacatctcaggtggcttgatccgggcaaaaccaagtaccctcctgtgtctggcggtatgtcagaagaccactgcccctcctccacaggccataacagccaagtctcaaactcaaagccaatggcgggcagtcccgatgctcggaaatgctgctacggcccccagaaagtggcttccacaggggatcgcttgcagctgtgacgcttagcgggcccactgaaagccgcgaatttcgcggggttatgcttgtgggtcgatcagtcatgtagctgctaagaaatcagctgcgctcggtacttgggccggtacctgactcagctagcctgcgcaagtacccaacgccggatcagcccatggcgatacccacgggcacctcgagacctgtgcccgggccctcagcccactcaaacacagcagtcccaccacgcagcacaacgtcagacacccggatgccggcgaagtgccaccgagaatgaggtccttgtcctgcacgaccgcatcataatccccatcgacagatcccgtgccatcgactgactcacaccagagctataggaagagctacggagctggctccattggagcttgcccctgtcagagagcttccggcgcgatggcttcacaaacgtacgttggaaatcttttctcgggcggactcgctcaacgcccgccacccagaccccggggccttgcctgcctcaacccacgactgtggctaacagagacttccgtgatgctagttccctcaaagacctgtccaaggcgatcaccgccttcacagccagcccccaggcccctctgcccgacgacctgacagagaccatcggctcctacctccagcgccattccaagtacgaggaagcagcggcagaccggctccaggaggagctcgtatccatcttcgacaaacatgtcagaggcaatcaagatgcctcctccgtatgggttggcgttatccgacagctactacccatactgcagaccgccgaacgagtgacgttttgggtggatattctcaaagaaaccctaagcgagcgctcaccccacgagaagggtatcgtggacgaaacgatcgggtcgttgatggacatagtgagctttgcggtcgattttcaggataactccgagggggacgagcccttgaacgccattatgcaccatatgttcacgatatggatggactgtttctacccggccttcgtaaagggtgttgcgggaatggagttcaatgaacgtatatttcgccaagcgatcatccaatttggaaagatgcggccacaggtatggcgatgctgatatccctagatttctggggcgctaagctaatgattcggtcaatagcaattcttcgcctctctcgatagcttcttcgtccaatcccagcatcgcaaggctgctctccgattcttatgcgactttatacagagccaccccccacatctgcatcagatccttcaagggaccatgttcaagaatctcctgacctgcctacaagaagatacgtctacggttgttgtttcgtcggccctgactgccttgataatgctgttgccacacatgccaagctctcttgtgccgcatcttccagttttattcaacatttatgcccggctattgttctggactcaggaaaaagcaggtgtgactgaaaccccatctcatgatccggacaagtttagtgggtgggaggcttgtgagcatgtttctggggccagcgatgaggccgtgtctcatttggcaaactactacacgattctatatggcctgtatcccattaatttcatggactatatccgaaaaccgcagcgatatctacgccatgccaatatggccgacgcagacgatatcgagattcagccaacggaaatgcgagatcggtctgagcaattcagaaggtgccatttactccatcctaatttccacactctaactatcgactcggagaaatccgatctcgagcggtggattcaaagtgaagcggcagaagtcattgcgcaatgtatggagctctatgtgggaactgaaaaaccaatcgctgcatggtcacttccgacgggggcaatagatgagaaacgagcactggccactgttgggtctgaggataacattgactcggctctcctccaccggtcaatgtctgggatgcttctcatggatgggtaccgctccgagcttaagagtagaaacgattcttcatccacgatagctcgactggactccaggatcagccttgtgtcagattggggcagccccgagattagggggcgtgcgtcaactcccgatggccagagactgctagccaaatcaacttcacattcgcagctacgagatatcatggatgcaacgaggggagccaaggttcggcaatccatatcaacagaagggaacgattcagataccacaagccatcaggatatggccaaggaacaaagcatagggcagtcgcagcctccagtagagagttcagaccccacacctctaatggcagaactcgcggcccaggtttcccatctacaacgccagaactttatgttacagaacgatctcagtttcgagagatatcagaagcagcagcatattgcgcatatcggagagctgcgtaggaagcaggtctcccaagctgcgactgaggcagagactcaaaatctcatcatcatgaatcgaaatttcaagggtcggtatgaggacgccaagaaggcagaaatgcaggtccgcaaagagtcagagaagagccgggcagttgccaaaaagtgggaggcagatctctcgaccaagatgaagaacctgcgggaccaatatcaaaagactgccaccgagctccaggctgtgcgtacagatctagaagcgacccagcaggaatgtgagaagctccgacaacttgtatgtgatggcgaggtaaaggaactcaactggaaacaaaacatgcagtctattgagctgcatgctgccgaggtggaaaggctgcgagccaaggctgatcgcctaggccaggtagaacaagagtgccgaatgaaagaggaagagcgttctgcagctgtcgacgccgccgtgtttgctgaaaacagagtggaggagatgatcatgaagctcgccgcaatcgagagcgaatcacagcagaccaggaacgtcttccaggaacagatcgttgaactgcaggcgaaactagcccaggcgcaggagcaagtgaaacctccggtgactatacagaggccagaaattcagggcatcttggagtcaagccgagcaaggcaggcagagatgcagcaccagtatgacatgctgatccgaaagtatacggctctgcaatcatctctattagatatgcaatctggagcaaccccagagcagatcaagcacgaggtatcgagcggaccacttaccggatcgccagagtatccctcacaaggctcaacgagtcctgttcggacaaggatacgacctcgggtgttttccaatcctgaggtcgctcctgatgctacttcctacaacgtgacccctcccttagaagggaaactgggtagcgtaggagcgtcaagttctggggccaggcctgcaacgccatcagcgactgaaggagggccaccgcccgtgagcccggaacaacgttatcatggtagaggtaagatgcactttccacctggcccacaagtctatgggaatctgcgctaacttgtgctaacttgttgacttaggcggtgtgcaaaacgttcgcaaggacgggaagggcaaacaaaaggaggaggatgttgctgcaggcagcactggaggaaagaaagagaagaagtcttctgggctccgaggattccgatcgggggtaaacgactttgtgcgtgggaagacggactaaagcgaaatttcggcctttatctatcaactaatttacgaatatccgctgagcgagatattggtaccaaatgtgagcctaggcgatgtcaactggcacctgttgatgatacactgaatgtgacattccactaggccgatggcattattgactcagcaaaaaatggtgccaatagttaccaacatgaacactttgtatctagagttttaatccacactggtcgaggagccgatgtagaggatacatacagggtaggtgaactggtaagacaagttaagccatagagaacctgcaataccatctgcggagatagatcttccctcttcagggtgttggtaggtgcgtatgagctgcatttgactgcttgccctgggggagaaaagcccacgtatgcaatcagaaagatctcgacggactgccttgtacatcatcaaacttcgctttgaaaactctatgccctagaaacacttacgggaacaataagaaaagagtggttcgaaaatagaggtagaataaacctcggtcatcaccctggcagcctcttccatcagcgcatataatgtcgggcttcgaatttgagtattctcctggaccgcaaacctgcgttgttctggggtcccatctccagccctcccctccagaaggttcatattcccatgattgcagcaatcctgtgggggagctttctgcgtctcattctggcatttcaccatcaataatgtagagtgtttccaccccaccataatcaaataagtcatcaagatcagagacactacatccgaagccgatacatcaactactacggcttgagaattaacatgtaaacgggacctagaggatgtcaggtcagtttagagaggggaggttgtttgattcagagagggggagatggattgtatgagagtgagcactgggggggggaggagggtggtctgcgaagcacagttcaacgctatgattatgaacacaatagcaggccggttctatcgcgtctcgtcgaaagtgttctgggcgtatttaacctatgtgcatggttaggccccggcttgaagtgcatcccggcatatcttgctctgcgcaagtgccaactgtgacagaactcggccacgggttctctatagtgacgtttatgaaagccatattttaatgcggaaataacaattgtaagcgtggatggttaccaattttgtcatcacccatccaggtaaattcaagcatcattgatgaaattcgtatttagatagaatcggcttgtggtaaactctcttgatcctccagatcccttgaatcaacccagtttccatgcaatcctgccctcagtcgaatgttcaaatggacaattgccctcgcggtggaaaagtctctagtgtctacgatgtgcagttcgctcgacatggtggcatagttgctcaccagcacgatcaggaagccgtcaccctcgggcgcggcatccgatcggggaacaaacacgggctcctggaccatgtgcgtcttcccggggaagtagacctcaagctggccggtgtggtggtcaagatggcccagggagttatacaaggggtgcccgccgccgagtacaggcatgatggcggcaaagtctgtgccccgggtaggatccatcatgtcgaagaagctatgcctgtggcgcttcatggacatgcgatcgtcgatccgggggaactccatgtcgcactcggcgatgacttcgtggggcggcagctcgaggtcggatgattttgggtccaacgtgaaccgcacatacttggcgtggatgtcgtggggcgccggggcgttcccgttcgcgtcgggccaccagaagaatacgttcttgtcggtcaaggggaggtcgaaaacgatgttgccctcgggcgtttcgtatgcatttgtggtgtggcccgggaaagcatttggagccttgaaccactaaagagaaggcaaaatcagtcactactgtgagtaacatggaaggccaatgagagcaggatgctctcgataccatgcataccttgatatcatcgcctttagcccctctgcgcggcaggacgcccaggtaaaaggggacttccgggtcccactgccagtgctcccctccttgcttgagtctctcaatatcacacaattgagggatcattggaaacagaacctgcagccgtcgattagtagaaatcaatctccgtaggggaccactacctacccagttttcagttactgcgaaatcgtgaatcatgcccaccacgggcgacacaagccagacaacctgcgtaaacttcccacttgggctgatgttgtagtaacatatgtctggcgtcccatcgcccttggcctcgtatccgaagcagaccagctcctttgtgacgggatccagctttgggtgagcagtgaaggtgaggctgggaagttggccgttgaaatcccaaaggccaatcgtatcgagtgtggcgggatccatggcccagggagctgcgtcttccttaatagccaacaacatcttgttaaagtatacgatgttcgtattggcagtcgtgcggatcttgaactcgacagcatccgtgaacttgttccggtacgcccctgtgcagccaggttatgaacaatgtggtcttttcagaaggcagcctgcggccaagacttacccgcaagagctctcttggcctccctttccctggtgaacttttcggtgcgcacgtacttttgctggagatggacgctgcccttgctgaaccgaaaagcactgatgttgccatcgccattgaaccacttgttgtcgagcattagcgtccaggcccatcccgtaccaattcgaaccactacctacagggtcatgctcaataaagggtggaaattgaggatcgggcatgacacggtagaaagtgccatcaagctctttgggcaagtcaccctcaacctcaagatgttggatctcgccttcgaagcggcatggcttcatgaaccccgaaaactggggctgttttgggaaggccagggcggcctcggagcctcggaaatgtccagacatggctaaaactaaagcgagcgaatgatacggttaagagagcccaggaaatagttagaggcgtggcacagtttaatactgagttcgaattttgatggcaaaggagcatgtggaagatgatcccgatttctccccggcgaagctgcaacatgtcactggtactaatccccgacttgccttggttgccctttatcactgtctctaggcgctgtaacaatacatgtataagtaatttgaatcattatcataataaagaatcatccttgcctttgatgttgttcatcttcatatataacttcaatataaatatactcatggtaattactttatctcagcatcaactccggaaaggtacctaaaatagcgtactttatagtagcggcacagtttccgaatctcccccgcaaaatccctccgcggatttgctcccgcgaatttcccccggattccgctaccaccgctgtccattaagaagaggtctgtggtggcagccagacactgttattaattcttatattcaagtcagtggctcgagaatcctgtttcaagacctgttttgcatcttttaccatatacgttattaccatatcaattgaacactgggcagcccaaagttcgtctcgttcaagcaccagacgacaactatcatgacttacaccaagcctcacccaatgaagacaccagacgatgtcaccaacataccgctcataatccatggcaccgacgtctttgacgagaccgagtcaagaacttacacctcgataggttgtcggtttcacgctgccgacctttcagattgccaggaggctctccaaagtagcagcaaggcgtttcagtcatggtctcggacatccccgctggagcgacgccgtttgctcctgcaccttgcccaggcatgctcccctctcctttcccaggaagaaaaaaaaagaaaaaagagagcatggttataggttctaatgctaaacagctgcttcgtcaacgggagaaagagatccaggacatcatccaaaccgagattcattgctctgaggtttgggcaactcaaaatgtccgcgacagcatcagtctgattgaaacaagcgcctctctcattacatcaagaagtatgagtggatcaatccctcacacagaaggcgaaagatcatttggattcgtcttcaaccggcccatgggagtaatcctcggaatcgcaccctggaacgctcccctagtcctaggctttcgcgccgtggtggcacctatcgcgatgggaaacacagctatactcaaagtaagtggtcttcgatgagcctatgcacgtaacatgagacgcgaaactaacggtcactccccccaagggatctgagctgagtccaaggactcaccacttcattgcgcaactgttcgttgaagccggtttcccgcctggggtcgtcaacttcatcttgcaccggccggaagatgcggcggatgtagtcaacgccctggtgacgcatcctgcggttcggaaggtcaacttcacaggctccacggccgttggtcgaatcattgccgagacggctggccgagccctcaagccggtactgctggagttgggtggtaagaactgttccatcgtcctgaaggatgccgatgttgagaaggcagccgaggccattcttcagggtgcgacgttaaatgtgagctcgaaccttctctaaactgatattgggagtggagttttctcatgctaactggtgcacaacagggaggtcaggtttgcatgtctactgacctggccattgtcgcggctgacattgccgaagccttcaaagagacgcttcgaaataaggtcaagaacttgcgcgccacatcgcacaaggccatcagtactcgcggggccgccaagtctctgtccttgatggaagaagccagggagaaaggagccaaagtagtatctgctgccactgaaactcagaccaacggtcgagacccccaggatgttccagtcaccttgatcgaagaccttgaaccatcgatggatttcttttctgcagagtcctttgggcctttaattggcgtggtagcggtcagcactgtggatgaagctgtcaagattgtcaacgagaacgagtacggcctctcctgcgccatatggaccggaaatcatcaccaggcgctggaactggcccagagaatcgacactggagctgttcacgtcaacgcatcaactgtgcatgacgaggcgacattgccccacggcgggagcaagacgagcgggtttggcaggtttggggctgaatggggacttgaggagtttgttaagactcagacggtaatcctgaatccataggctgcaggaactccacccaagccagaataaaatcatcattttgtcacatccttcgcccctaaaatgggttcatttcccatcgaatcgtaggtagactaagtggagtgtacgcaatcaaccaaaataagcttgaccagttttcaacctacgcatatgtgcgttaaaccagcaagcaatactttgtgagttagaaatatgtgccgacgagtgtttgtcagtgaatatcgtaacaaaaattgacagcatcctgactcagttagccctaacattggttactgagatacgagagagaggggggggaagagattgtaaagttaaacaacaataaaagaaacctgacccggcacctcaacacaatgaacacgattactgaggtacagctcaagtcagtaagttaattggactaaaataactatctgtgtgaaagctacggcgttgtagcccgtctctattgagtaacatatttctcagtgtcgaccccttcgacacggtaaaaaccaagggcattgagcataggcttgtcatcaaaccggtaaaggtagaccttgctatccccgtccgcaaagtgctgataatggtgccaagcaggaatacagaaagtatctccttgcttccattgcagggtcgtgccgttgattttggagtagccagatccttcaatgacatggtagatggaagaggcagtctcgcgaatgccaggggattgagactttgggtcaagtcgttcggcagaagctccgatgataagaccgactatataggaaagaaacatatcagcgatatccagcgagctttctaggaccagggcaacttactttctctgccgtctttcttaagatacggctgcgagacccaagcgtccgagctagcatcgagcttagcctgcatcttgtcccaggggaagacaataggtgactcgtccttgtcctcggcaggatatcgagacttggcatagtgctccacgaaatggacggggaagtggatgaagctgggcaagtctagtccatcgagccagatcacgggctggtcgtcgccaccctcctcatcggcgctcttcttgccatggtcgtgccagttccaggttggggttacgatgacatcgcgaggacgcataggaacgcgctggccgtgaacagctgtgaaaccgcccctgccttcgataatgaagcggcaggcaaaggccgtgtgtcgatgtgcgggcgcagtctcgcgaggctgcacaagctggagaccggcgtacagagtgtccgtagtgtatggtgcctctatggagatgcatcagcaatgtagaatcacacgcagagagaaagaaggcagagcaggagacttacctcgagctggattggcaagcatcacgactcgcctctccgcctgtttctcagtgatgagatcgcccgctcgcaacaggtacggccggagctcttcataagcccatacgtgggggactgtctgaggattcggcgctggaggattaagacgctgcatctgagcccacagcggggccgttttcaaggaccgcatctgctgcacgagctggtcttcggtctcgatggacttggccgggactttgatgtggccatttgttgccagtccattcccgttggctacgtttggggctgccattgtgcggtgttgatgcaactgttgagtacttgcctgctaatgctgatgctgaatatatgtctatcatatgtgtaggtatgtttcaatgtcgaattgcgacgtctcgcttgaagatatacaagcatctttatgaattgtccctaattaccaaatctggtaactgtcggggaagcttcccggcataagcccgcggggaagaagcagatcttcacggcggggcaaattcggagcacctccggcaccacgacttacaagaccatctcgaaatacgccagcatattacatgtaagtcagctccattcattttattacaagacgataatctctctcaatcttactaacttgactatctcacatgattttatcatgatccctacgcacaccatgaatggggatagtgtgaccgaaaaagtatgcctctacatacgccttgaaccctataaagtccgagctactgacatcactgacctgtacaaaagatctatgaatacccctctcggtcaatggcgcttctcaagagaattcaagccacctatcatgaccagaaattccccgctgagaggtcccatgtgccactccgagtgctggtcgttggggcagggctgggtgggttgagtgctgctatagctctggctcgtcgcggacataccgtgactgtccttgagcaagctgcgcagttgggcgaagtacgttccagtatatcaatagcctgaccctcgatgatcccttgctgactgggtctatttaacaaataggtcggcgcaggcattcagatcccacccaattctggccggctgctctcctcttggggtatcaccccgttcttcaagaacaaagtggtacagccggacagcatgaccttccgccgatgggagaatggagcccctataggcttcacgccgctcgtcccccacttctcggatacgtatggtgcaccgtactatgtcatccaccgatcacacttccacggtgccctgtgtgatctggcggccaagcttggggtaaaggtggtgacgaacagcagagtagtaacatatgatgagagcaagccctctgttgagacagcggatgggagggagttcactgccgacctggttgtggctgttgacggcgtcaaatccatcgctcgccctgttgttctcggtggagtggacaggccccctaaacaaacaggattcgcggcgtacagagcagtcgttgacactgatttgatgaaagctgacccagatacagcttggctactggaaaatcccggaatcaacatctggtaagctcgttcttagatattaaaatccttccggtccagtggctgacagtgatgagcaggatcggagaggacaggcatgtaatgacctactgcatcgctggaggaaagtcgtttaacatggttctttcccatgttgaccgcactgacccgacaacatgggcttctcgggatgctgtaaaggagatgcgagttcagttcgagaactgggatcctaggtaagttccctcctctacaagggatcgttgttgggcggcgcaattcttacgctcgacgtcacagactcacaaaggtgattcatatgatcaccaaaacgatccaatggccactgctgagcggcgcccagctctcaacctggatctccgaaagcaaaaaggtcgtcatactcggcgacgccgctcatgccatggttccatacatgtcccaaggtgctgccatggcagtcgaggacggggccgcattagctgaagtcctttcactaatcaagtccccgagtgagattcccgaagcccttcacgtattcgagaaggagaggatgcaacgcagctacggcatgcagcgtgccagtctcgtcaacgggaagctctggcacttccccgatgggccggaccagcaagcccgcgatttggggatgcgcgccgaggttgaaggcctatcatttgtcgagagcaccaatcagtggagtgatccgaccacgcagctttgggcctatggctatgatgcggaagaggaggtgagaaaggcatgggaatcaaggacccctcaggccactgccaatggtgttcacaagtagtagatgcaaataaacatcaatttaattcatttttcttcggggtctcgcagatgcttcggctattgctccttgtaataaaaacgacacatctccacggcatctaggctggttcaaatgttatgtcgtagatgttcacgccattcagaggacattacaattgatgttttaaatgcgtgtttaggaggtattccttgacttacccccaaacttttcagttcctacataactttaaagtagttaaatcagatcattagctaaaaactcactttctagagagccacactgagctgttattgagtattctatgcatgcatattgttttcttctggtctattctatttccgccacttcctgagctaggtcaaggcccgagaaattccgtgtttactatttataagccttgaagaattcaaatttttgtcctaggcgaaatccaccccgtttctgagtgttcctatgctcgaaatgttcacttccatgctcgtcccggggacaagatatttcggtggcttgagcccggcaccaacacctacaatttggagagattagcatttggctttaccagaaacaaaaataagacagaacggatagcaatgctcacctccaggagtgcccgtcataatcacactgcctttctgcagggtagtccccgacgagagatgagcgatcaaccgcgagacagagaataccaaatcatccaatccagcattttggcgcagctccccatcaacaattgtcttaaggtggagggttgaggggtcggggactagagtgctcgacaccaaaacagggccaagaggcgcgtatgtatcgaaccctttggagaagccccattgagggacgcctccagccttcgccggatctctttgccatttacgagacgagatgtcgttgccggccgtgtatgcagccacgtagtcgagtgcttcggattcgggaacatcctttgcgtcctttccaatgaccacgacctagtttcaggggcaaaggtatcagcattttcctaaccgccccgacagaactaggtgataaaatgggccatcttaccaattcgccctcataatctgcctgatcatcttgcgcgatcttgggaatcaccactgtagctccatggtcggttacggtagttgagggcttgaagaagatggaagggaacggcggctgcgttcgacccgcctcgcgaactatcgcactgctgtgagcatacttggcgcccatactggccagcaaacaaggaacaactcactgtgagtggcatagttcagcccgacgcaacgaagtatcggcacatccgcgggggcgagaggaccgaggagcttcttgacggtgacgacctcgtctgtcactttcgtggccccggctgtatcgtatatatcctggcccttgacgactttggcttgcaggccagtcttttccgtggtgtcaccaatgtcaaagtcagggttggtgagaatgggctctccgtagagggtccggccgtctgtggcgacgaagcgaatcaggcgtgaccaggcaaccttcattttgcagaatactggcaagcaatcacgcgggtacaaaactgctgtaggaaaaggaactctgtctacgtgccatttttctcactcggtggtttgttcgttcctcgcgttgaatatgacctcgattccccggggggaccatcccgatggttccccggccccataaatctcgctcctccaaattgctccacctctccccgcactttggccgcggaccttaagccaacggttccccgggattttgtacactcttccctcttcgcttactgcaacagctgtcagcccacaatcgccctaatgtcagcggccggggtcccatcggagcgacaggatgacagtaactcaacgagtgaccgaattgaaggcgctgcaagccctccggcgccgaaacggaggcgggttggccttgcgtgttccgcctgccggatccgaaagtccagagtgggttgaatcctgtggttttgactggcacaaattgggagtgaagactgatctgtcgttgacagtgcaacggcgtgcgccctaaatgcgacccctgcgatcgcttaggattcgagtgcatctacgagctgcccgacgcgtccgccaatctgctcgtgcctcgagagtgaggaagaagccccccagctagaacgactatctaggtctttagctcacagcaattagcatatttgctaccttagaaaccaaggtcaagctgcttgaggctactgtccaacaacaggaccaacgaatcaaagccatcgagacatccaatgtcaggaaagatcgccacgtagagtttcccgtcgcccgccacgaggctccggctccgggcccgggcatggcgaccggcgtcattgtccatcccgaaggcattgaagatgcccccacggagcagagcatgactgatggtatggcactttcttttgtcaacgaagaagactgcgggttctttggtaagtctctctctcaagacccgcgcccgtgaggactcatctcatctcatcatcgtcgtctaggcccgtcttcgaacattgcgttcatgcgtcacatcttccgtgcaatgtccaagaaaggcattacgagccaaggtcggtcgccggactcgcccttgaacatcggcgcctatcaggccagcatgataagcgtgccgcagccagtgtcgtccatgtctgtccaggagcacaatggggaactggaaaatgctgtccaagccaatattctaccgccggaggaggagactgaaaagctcatccggtcctacttctccaacactggccttctcttcccttttattcacgaagacacatttctggcgacgtataaccgcatgcgggaccagcattatcgagccaatattagacggacctggctcggtctactaaacatgatagtggccatggccatttgtacgtcgcagtgggctgaagatggtacagaatatcgaacggaccagtcagacgtgtattatcggcgggcgcgagaactctgcaaaacccagatgatgagaggcactactcttgagaccggtgtgtggcgcttgacctaatgccaagcactctagaaagctgacagtgagcacagtgcagtatttattgctcacgagccagtacttgcagggcacgcagcgatcggtccagacatggactacccacggcttagctgtgaaggcggctttatccatcggtctccactcgagggacgtgatggcgagattcacgcccatcgagcaggagatgagaaagcggacctggttcggctgtgtgctattggataggtaccacagcacgatttgcttaccaagggctggctaggtagctaatcgcgttcactaggagtctcagcatgacgtttgggcggccgggcgctattccagaggagtatatccagctagatctccccacaatcattcccttggatgatggtaccgaagcgacgtatagcatcgcaagcgtcggcttcttcaactctaccatgcacgcctcccccttcttctcgcaagcgttgaactaccactaacggttcatcttcagtcttctatacagagttctgtggaaaatcgtcgccactctttatggccataatcttgccagcgtagagacaccacccgagacgtggatgattacgcaaatcttccaactggagcaggaactcaataactgggccagcgcattacccagtccgttgttcttacgtagctccaccaacttaccggaagaaggcgatgtgcaggatgatgttctggaacggttcagagtggttctctcgctgcgatacttgagcgtgcaattattgctgtacaggccggtgctggccgattccctcgcccgcggaacgagtggcgaaaagcagcgctcagtcagcaaagtccaggccaacttcaacttcatgtgcgcgcaggtcgcagaggacatcatcaacatcatccacgccgttctcacgaagccgggtctcgggcggcatctcatgggagcttggtggttcacgctgtattatagtaaggggagccccccttcgtccccgtgacacacacctttttagtccagcacgccgctgactttgtttcctttaatcagcattcaacgcggctttggtcctgttcggtagccttttggtgccgatccaggacacggcgaatgatcccttcggggtgggggagatcaaccgtacgaagcagtacttggaaaaggctgtccaaggcctcgtccagcttggggcacggaacataaccctccatcggtgcgtcgactatctgaagcaactggttgggctgcttgatagttggggtttgttttcactcgtttgaactttatagataagccactttgctgacacttgccacaggttcatcaccccctcttcatctagatgggccaggttcgaatactctctccagcagcgccgcccaagatgcaaatctcttatccgacctgctctccagacctccggcattggaaggacccggggtgggctttgaagatgatctcgagcttgggaacttcttcacgagcgagttccagcggtggtttgaccgattcccgacgtaagacgtgctacaacgtcccccaacgagcacctgacagcagagtagtgaatacaccacaggagacagaggagactacaatatatgccgttgacgacgaataatatgctggtgtgtaaaggatgacccttcttaatataaatggtctagatatacattatcctttactcataaaattacaaaagaacatatcagcttaatagttatagcagaggcccgaacctgtgcagatgattgacgacgccggcaaactaggaccgattgcctctgaaatgccatgggtctgtcttctgcacgcgcgctaaaatggattccaattgatgcaattcaatcttgactggatgctggtgaaaaggctcaccgatttaccaaggataccatacgaggagtaaaggagaacccacgtggcttggtctaacgcaagagatactacatttcggaagcccagctaagatcattaaaatccaattacgtccaatcagttcaatcaccttgagtgacgcataacagctaatgataatgaatcaattcacacccagacatcctactaccctatatcactccgctcctagcctcctaacatatgtttaattaacttgattgcttgtctctctttctttaattatatataagtggagaattcttttatatatatatatatatatatatatattcttttttttttttttttttttttttnaataaattgttatgatgttatattctctaaacgttagatattggtgcctcggcccaagacgcacctggccacaacggtgagcgggtaccttaaaagcatccacaccactagacctggaatccaaatcgggaaatctgtctcctgtgaacacatctgtttatctgatcgttaccttggatgcggagaacccttcactcctggtccccaacgtagcagctcgatttcattttctgctacgctgcacaccactttcctagcaatgtctctatcttctcgactggggcgtctggccttgtgcctggcgcttctcgtagctctcgtccatgctcaaaaggccgccgataaaaccctcctggacagcgtgagcctcgatggcctcgacgagcaactccaggtttgagcttcccctgggaaacatgatccgacgagcaggcgaacgattgctaacagctcctcctcgttatatagacctgccccatcgtccaggagctcaatgccgctaaacacgccaaacactcggcggcgccgtcctcgctgaccacgcgcctcttcgccgtcctcttccccggctccccggccgtcaacgccctcctcgcgacgctgtacatctccggccctcccaacttcctgctcgcgctctgcccgaccgacatcgacccgtcgtccctctccgtcatggtggcctttgccgtcggcggcctgctgggcgacaccctcttccacctgctccccgagatcttcctgggcgaggacgagcccgagcgcgtccgcctggtgctcgtcgagcccaaccgcaacctgctcctgggtctgggcatcctggtcgggttcatggtcttcgtcgccatggacaaggggctccggatcgcgaccggcggcgcggggcacgaccactcgcacgggcatgagcacgggcacgcggagatcaagagcgaggggcacgctacgggagctgatgcttccaacgggggggttgtgtcgaggaagaagaagggcaagggctccaaggaggaggacgccgttgtcgagaagaaggaggttaatcccagtgtgaagctcggcggttacttgaatctgatgtatgcccgacctggtctttcgactctacaaccctctctcctagtctatggtggctgctaacaagggaattgctgtttagtgccgatttcactcacaacatcaccgatggtctggccatgtctgctagcttctatgcctcgcccaccatcggcgctacgaccaccgtcgccgtcttcttccacgagatcccccacgaggtcggcgactttgccctcctcgtgcagtccggcttctccaagcgggcggccatgggatcccagttcatcaccgccatcggagctctgctgggtaccctaatcggcattgccgtgcaggagtttggtggcagcggagcgagcgcgggcgacgaccccatggccaggaccgctggactctggggcaccagcttggtaagtacagatataactcacctttgtttcattgactcccttgcgtgggtgtggttgcttgagaattgattctgacttttggatttccagacctggggagatatgcttctgccattcaccgcgggaaccttcctctacgtcggcaccgtggccgtgatccccgagctgttggagacgggcaagaacaagggcgaggagctcaagaagaccctcgtccagttcacggccgtggccgtcggggctggcattatgctctacatctcctggcacgaatagacggagtagactagcgagtttagaagaggcggctgggtctttgtatgaatgtgaggaaaacgaagggtgagactcggcttgacttggaactacttattattggttgtttgttcaacggggttggttagaggactgtgcagttttcagaaataccggcggtgtgagataaaaacgtgttgagcgggagcaaacaaaaaatgttatagcatgtctggttagcggatatcattgatggaagttttaattaacgaggtttgctccgtcacatttccaaaaaaaaacccatgggcctttttcctccattctggcatccgtgctggcgtctggcctaacatggcgctattgacaaccgagcgaggtcggcagagtggtgacttgtcgatggcgtcttcagggtcctgctgcccggcccacaacgcaggaggacagggaggggagggcatgggcgagacgcggttcgggaagccattaaggcgagcgaaggggcgtggcagcatgcagagaggcggctctacccggcgcgcgtatcccaacccggccatggccctgaggcgagagggaattttggcgcacgcagggtctttttcttcttcttctttttctacggtgagcgaggaggccgcggagtcaatagttcccagctgcttccattaccttattatttccaatcgtgaagggagctgtgagggcgtgcagtctggactggtgatccctgtagcttgagatgtcacttaagacgtgcctgccataaagggcatataattggcatctttttaccttaggcctgtttatggggatttatctagatctggcggtgggtttccatagttctggacagagggatgtaatgttatatttttccaaacccacagaccatggacggtgagaactggagaatgtgctgggctgtgtaggaatggcttttgataagtttccgttcctagattagaccagggaaggaggtggaagtaagcactggcagacgccgatggcctcgtggccaactggcatgtcttattggatacgtgcactcagtttcgaggttgtttattacagacggagaggcatatgctggggataatcatggtcaaataagttacgttcagagacgacgtacgtggcagtagcagccacctgacgtcctctttctgaagtcatttcctattttgcttgaacgtgttagtcaatgaatgggaaatgctggagaacgtgggtgggaagaagagcacgatgccaaaaggaggcattagctagtattgacgcaaagacggagcacacttttgcgcctggggaaccaggaggcgtggaataagacggggatgaaattagcgggaacgggagggcggctcgcgaacaacgagcctaaaaagccaaaagttgaagaggaaaggaaaaaaaaaaagaaggcgagctcgtgatctgacagagggctcccgagatggaaagactgctctgacccggggacgaatacaggcaaacagagcggtatgtaaaagcggcgatgacaggttcgtgggccgtcgctagcccaaaggaggggatcggcaagcaagtcgtgcaggagagacgcccaggggaccaagccaggatcggctgagcgccaatgcaccaagggacgggtaggcacatgaaggactattagagcagaggcttgcttgatgggcagggcgagcgctccgactggtgcgcggccggacagggggctgggacaggcatcggcagggcaaggcggctctgatgaagcgcaggtctgctggtaggttcgatgtcgtgatggccaacaacgtgctctacactgtacggctgggggtgtggcgtgcgtgagtctgccagtggagatgggatgagaggtaaaagcgacatcggcatatctgattaatgttctgccaccaggagaaggaccgaccgatggatggggggaggagagaagggggaactctgttcagccagggacggcgagctcgtctaagccaagcagactatttgtctgaaggtaaatccaagggaccatttcttagattgtgtgattaaaactctccccgcaactgcggatgtgcgcgaggctttagcggtacagcttcttgaccaagagccactataatccccaggtttctttcttcattgcagcaactgtggatgtgcatgtctagatcccaagtgtcaagcaccaaaagcaaattctagctaggatcccctagcagtgggcacatcaagcgtgcatagcagaatgcgcgctctcatcgccccctgccgctctcaagacaaagtcaaccccacgggcatctatgaccgaccgcgacctgggcaccacaacctcgcgataattactttcctcaccgctgggaggttggtagggagacgggcaagtccgtgtaagccatgagagatcagtaggcgaaaaaatggaagtggaccagagaatggcgacagcagtggatccgttgactaaagaaaaccagccaaagagtcattgcattgacacactatcacttctacaagtcagcgagccagtcatgaagcagggcagcccgggacgctgctggagctcatggcagagcttccaaaaagaattccgagtagctcgtcttccgaagcttctgacggggcggctggtccagattggttctggcgcgaggctgccacgaagctaccgtgagccaatctgggcaaagggcagttggatagagaccacgccgggggctggttgttattttgggtcgttgcggaacaggggtcaggaattttcttcaaggtcaactgattccaagcgaagggtccagattgcatgcaattgacccggatgggagggcctcgagatgaaatggtccgacggcaataagatcctgaccgtcaatgccgctgcccgtcgacgaagctccgcgaaagcccaccggcctggcctgacacacgtgcgtcgtgtctgaagacttcccctctgggtctgatggagaagggcagccagctggtgttgtccccaagagagaacgaggcgtggaaccagtggaacctcatgcaagtgctgggattcagttactctcttgggagatcggatcaggatggatgcaaggcacacagactgtgcacccatgatctgtcgcctaggtggtttcatgcttgttttgacaggcagagtcgtgaaatcatcagcaccacttgttcctcccctcccctccatccggatgcttacgatcgcgaggcgtgatcacgatgtgacgggcaaaacctcccgttttgtggcccatgctggagacagaagcatcctttatgatgcaatgcatctgatgtccctacaagtcggagattgtcctccgcctgcctcccaccatgatcccgtagatccaaacagtatgtacatagatcgatcgcacagatggcaagaaaagaacggcgtgggtgaattaggatcgcgatgctacagatgagacaatgcggcgagacgggatgattcatcgcccactggattacgggatcatgggtgcgccacggtggaagaaaggaagccctgccgttgacggacaaatgacaacagagatgcgcatcaataagcatttccaccggcatctcgatagctggaatttcacacagttagtcgcggcttgcacacacatgacccccaccactggcctttgcgcctttgggggatgcggtggcctaatcattgcgagcagctggggtatgctcttttgcttcctttccagcccaagtgcaaaggctaatagcattatcgatccatccgcccactttcaaaagcggcatcagggccagaaggtgactcaggccagtgggagtgcaccgtgccaggcgtcagatccggccacacccacgatgccttcacacacccccccggaatccgtcccggcatttgacgacgataaataatctgcctgcctggctgctgtctgcttcgccatggctgctcgtcattctcacccataatccttaatatatatatatctttatacatctcccttatcagatctgtcctgcttcgccgtgtctctgtatagacaaagattgattgatatcacatccctaccacttatataatataccctccgaccatctatacccaaacttacctcttgccctatctccccgcacgacttggcttacgcagttaccagcctttgggaagccaccgcatcatcataaccagagcgtcagctgttttctgtatctgccactggccagctgatcacgtttttttttgcttggcatccatcccctcatccaaattgaggagtgcataagaggaggcaaatcgccccaactaccatcttccacctgctcttcatatctgcagcatctagaattttctggattactacccgcatcagaaacgagagcttgatatgcccggtattgtcgacactgctgcgcgcggcgctgttcgccccaaggctggtggcgtcgccaagcccagtctcgaagttgagattaaccagcacttcacttccaaggcatatacctctggctcccacgtgtctggccatgtggtggtcaagtcgccccgcgatttgagctacgatgccttcaacatcttgttcacgggcacagtcgcgacccgccttgattttgtccagtcctacacaaccaactcggtaaggacatttctgaagctgcgaatgccaatcgacaacgagcatcttcctgaggatcgggtgtttctggctggaaagacatacaacatccccttccactttgtcatcccccaccagctcatcatcacgtcctgcaaccacggttgtgagaaccctgctgtcaaggaccagcacctgtacttgccaccaaccattggctactgggaggctgacgaccaggccccggatatgacccatatcgagtatgccatcaaggcccaggccgtttctcgctctgctccaggcagcgagaccaagtacagcgttgtcgagggcaagaagatcatcaaggttctgccagccctcccagaggaggctccgttggatatcaagatgagcgatgagcggtactgcatgagcaagacaaagaccctccgaaagaacctctttgcaggcaagctgggcgagctcaaggtaaccggacggcagcccaaggctgtcatgctgtcaagcaacggcctctctgcctccgagaccaccgcacggatcaacctcgagtttgagcccactgtagctgatggagtacctccgaagatcaactctgtggctggcaagatcatcacgaccaccttcttcggtagcaccccccaggacaagttgcctaactttggcccaaaggactcttatgccatgaaccagcttctcacatacgatggcacccacaacctatttaccacccgccccgagaaggtgtcgtgggcccagagccgtattcccttgctgcgcaaggattccggatactcaactgtgggctccaccgacgaggacgagatgaccgcctccgacgaggaggcccagtcaagctcccgggtgaaggagaagaagaagaagtctcctggttcaggcgtcaagcactgtgctgccatcgacttgcccatcaagatccccgtctcgaacaagaggatcttcctccccactttccacaactgcctgatctcgcgcacgtacgtgctgcagctcaccctgtccgtggggccctcaaacacgacattttcgctcaacgttcccctgcaaatcggtgtcgagcagcgatttgaccctcgggacgacgacgagctcccgagcttcgagagcgctatggctcaagttgagggtgccggacccgacgattacctgcgtcctcgctcgacgctgcaggttccaaacaacacaaacaccatccccatgccacggactggcagcattctccctggctacgacgaaatccgccgtccgtcggtcccagttgcttaaagctgtaaatctgggacgcaatgaatcgatataataataataatgtacgagaggaggagacaacaaccatcacgaatcacgatcagtttttgtttttgttttatttggttgtttttagcatgtcattgttgcttttgttgacgcgatgggaggaaaaagaaaaagctgtttcagatgcactacttagccaaaggttttttgttttcatccgttcttcggtttcccgaggcaatgtttggacacacatggtatggacttggatatttcttttttgacacgagcgctgcatggcattgagagtgagagtgaggatatggcgttttctggtgacgatgatgggaccgtgacacgaacatagtaatactgatgatacccgccagcccctacacaaaggggggctggcattgcgatttctcctggaatgatgtttgcccccggcccagctgtaccgagtctagctcccgtacttcccttcccggatccaagacgcagtggactttgtagatgtaaacgtgagccaacgttatttatcttgggcgtagcgcagggtcctgagcgtggtcgcgaggtgtgccgccacactgggctgcgtctcccgtgagacagtactgactattggctgcatggtaagcaatataatgcttggccgcatacttgctgcacaggatgctgggaacggcatccattggagaggattcaacggcgagatctaacggcgagatctaacggcgagatctaacggccaactggtgtaatttttaagacatctattgcatccagcgacacaagatggctgccctggctaccggagaatagatgtctccccggacggtaagcgaacgccaagacgatgcactcccagattttacggtcgcggccgtgtccagagtcgatgcaatgcgctagcagcgtctaaaatggaaccatcgaccaggtgccccgcttttaatgcttgtttgacgggtcgctggccacttggcgagcgcgttcagccagatcgagacattgtgattggctggggatcgctcgcacctgccgcgaccgctaccgaatggcagcctggaaacggcaaaactgtccctccgaacggcttctgccattctccccagggctgattcgtacctctggctggcataaagactcgagacccctggctaattactactcaggagtgctttgctggcttccccacccttgccagccttcattatcatacgtcgtctttcgacccttttttcctcgccccccctcgggtatcgtcgtccattccatttctatcgagaatatattatctattaatcaggctatttgttacttttgcaggccaagccaatctgctggtcgaccgttttgtctatatattgtattatgtaatgtttacccgacctggcgttcccactccaacattccttacctgagcaagcctcgactatttgagcaccactcgacctccggtcgtaccgacgatcaccgtaccccttccagattcccaattccaccaactgcggtggcgcacatacccgcttcaattctacgacaatctcgaagacacgtcagacatcctcccgaaaagcttggggcgccggacataagcttccgtctgggagttggagacgtgcggtagcacaagcacaagcacaaaccacaccatccacggcggacggcccgcacttggtgcattgggttggacgagctgccaggcaacatggtcatcaatccgggggccgggcttcgcggcctcttgtggctggggctcctgaacacggcgggagctttctacatcccgggtatgtttcgcgcatcggcctggcggcgttgatttttggcgcgcggcggacggctaacagaaaataatggtttttaggttggtcgattctgagctacaaggatggcgagcacatcccgctgctggtgaacaaggtctactccgacaacacgcagctccagtacgcctactacgacctcccgttcgtctgccccccgaccgggaaccataatgcgggaggggggctgctgagcgggcagagcatccccctcaatctgggcgaggtcctgcgcggagatcggatcatggtttcggacattgacctggagatgggcaacgacaacctgtgccactcgctgtgcagcgtcaagctgtctcacgatgatgtgcgccgcgccgagggcatgatccaggagggatacgtcactgaatggatcgtggacaatctccccggtgccaccagcttcgtttcggtcgacaagacgcgcaagtactacgccgccggcttcaagctgggatacaccgagtattcctacactgccaagatgatgcacacttatatcaacaaccaccacaccatcgtgctccgctaccgcaaggctccggggaaagctggcgaccgcggggagaagattattgttggattcgaggtctatccgaagagtattggtccgggcaaccgccgagatgagaagggatgtcccatcgatctcgtgcaggtggatggcgcttttgagcttcagaagaacaagacggtccaggctgacggaacactcagcgaagatggccttaccatccccttctcgtactcggtgtacttccgcgaggacgacagcatcgagtggtcgcaccgatgggacttgtactttgttaaccaggaggagggcaaccgcatccactggcttgccatcatcaattctctcatcatctgtggtctcttgacaggaattgttatgatcattatcgccaggactgtccgaacagatatcaagggctaccaggaggcggttaccccggagggaaagctcagggtcaagcgcagggtcaagtccggccttttcaaggagaagcccgccggcctcctccagcaagagggcgaagacgaagaagctggcctatcagaggaggaggaagctttggaggatgttgcaggctggaagctgttgcatggcgacgtctttaggccacctccctttggtgttatcctggcgcctctggttggatccggtgtgcagctcctggtcatggctctcggactaattggcctgagcgcgtttggagttctcaaccccagcttccgtggtggtttcatcagtgttggaatcggcctgttcatctttgctggcttgttttcgggatatttctctgctcggacatttaagagtttcgacgggcaggaccaccgccgaaatgcctttgtcacagctatcctgttccctggcctctgcttctcgatcatgttcatcatgaatctgttcgtctgggcgcaggcctcgagcacggcaattccatttgggacactggtggccatcgtcgttctttggctctgcatccaagtccccctcgtgtacgctggctcatactacggatactggaaagcagcagcttgggagcatcctaccaagaccgcagccatcgcacggcaggttccaaagcaggcgtggtacatcaagtcgctgcagtctattctcctggcgggcctgatcccatttgccgtcatcttcatcgagctgctgtacgtgttccagtctctctggcaggataagagcgggtactactacgtatttgggttcctggccgtggtttctgtgatcctgattgttaccattgccgaggtgacgattgtgactgtctacgtccagctctgtgcggagaaccacaactggtggtggcagtcgttcctggtcggcggaggcagcgcgttctggatctacggctactgcgtgtactactacttcttcaacctgcacatcactggtgtcaccagcagcttgctgttctttgcatacagcttcatggcgtgctgtgtatatggcctgttgacgggcaccatcggcttcctgagtgcctatgcatttgttcgacgcatctataagtgagttcaacccgttgcgcaacgtcgatcattcaagactcaactaactggaaatagcgcaatcaaggtcgactaaggagagaagaaagtatgacgacgacaaagacgaaaggggaagaagagggagcaatgtgtggtacaaacatatgaaagcggcatctgtgcaacttggggcgttttgtattgtgattttggagatggaatgtgaaattattaatttctaatcaatatccgaggctttgtgatgctacctccttggaaactagcccttcgtcttgatgattggatatggcggggaaatcttggtgctctctgtctctatctactcgtggccccattacgagcccgtctctgttggcctctcccctgagtgcgactctgagatgttcccgtccgccatgagatagtggttcccattgtgttattgaactgtggaggaccaggcgttacctgtggatgttgaaaactcaactctacgtggtctatcaaagcatcacaccctttacttcttttctttgtatacatctatagatcaaatggcaacatatctacgtttttttgttttatttaccaaacatcccacaggattgagtatcactgttgtactggctcatcagtattccaagtatatatgtcaataagcgactctttgggggtaggggactcctccgtgcgcgataggtgtcatgtgggcgatatcctcgcgatttgctcgacttgcttggcatccatgccaataacaaaggtaataatgggatgctattcttcacgagcagcgggggggggatgatcgagccgcctccttgatcgaccggaataccttcaccttctaaatcggggttcagccggtgaacggttatgatactttccctccagagctctcagtcaaaattttggctcaacagtcaaacgaagaaagcccccatttccacaaccagagcttcaatggccatgaaactgccaaagttcttctcaggcgtaatgcgtaatcagaacctgtgccgcctgcacacccctctaccgccgaatgtggatgatgggctttgcagggccctgaatcccttagccagggacacgcccgcggcggttggtcagcgcccggaagttcggccacggtgccctgcttttgtcgtgcagataaaggattcgcacgatgcaggctcgcttcccgccttagcgtggggggggggggaagtggccggaaaaataccagagcagagctgcagatcaggaaaccgtgccaagccgtaagcagcctagaatagaaatcggcttgtgataccacggtgcgcagctcaggagagggcggttaggatgggaactcatggatgttggttgtttgtgcttctggtcaagcttttttctctcgagaatttcaaggacagcaggattagatcaagtgtaaagagtaggggaaatattgaactttccgttcatgtcatgatattctttctctaagtgtatagtggtatcttatgaggcggccgttaagagctgggccaaagtgcccagcagcgttattgacgtgtgtccctttctctgttgtagtaggatctcctgtgtcgacgtcggtcataagcatcctcgtcattatcgtaatcatcatcatcatcgccctggtctccccttctgctccgcctcccgctccggcttctgtcttcgttgaacctgctcagatcacggcttcgatgcccggccctgtgatactcatcgtcgacgccgccattccatgtctcggaccgggcccggcggccaccgatgctctcgcttctattcctcctgacctgttgatccttgcgcagctcgcggtctctctttgcttgttcttcctcttcctcctgctctcttctccttctctggtatcgttccaggtttctgttgatgctgaaaactgctactgcgcctgtcagcgccagcatggcggtctcggtccagtcaaacccgccgtacatcttttcaacttccttgcatgtcatggtgccttcgcaagatgcatggcggccacggcgggaagaagatgaggagggggatgaagaaggatgacggcgacgcggatcgtgctgtcggcgccgaggtagttccaaatcatattgccggcgtgaatctaggtccacgtcacactgtcgtcgtgaatccaggtccaatgtatatcttcggcgcgggtctacatctggatcatactcttgacgtgaatctaggtccaggtcatatcgtcgacgcgaagtagtatccagttgatattctcgacgagagccaggatttagttcatattctcggcgtgaggctggctcgacttcatactctcgccgcggatctaggtcgagatcataccgtcgacgcggatccaggtttggatcatgatgcccatgggaacttgggcctagttcgtattcttgacgtggatctgggtctatctgatcttcttcgccaaggtccaaagctgaatcatactgctggcgaggtttcaagtctgaatcgggttgtcggcgcggagctaggattaactcatggtgtcgacgtagaggcaagcccaggtcatggtccgaagacattcttgccagtcgagcatgccgtattcccggtaccaatttgtgttatccgctgccgggacgcagacctagcggagccaaaatggaacacagtaatgtgtgtcgatttgatatgcctacgtagagagcgcactctattctggtatggggtagttggtcatgaacattgggaaaaggagaaggggaatggcttgctggagagtggtgatctgctccactcatattagatttatgtctataatgcctccgttgtacgacccttggtggaacggacggcacaggctttaaaagaaccatggacagatagctcacgtaatgcatggacgtacgtggcaggtttcgttcgcttaaccatggatcatgcagatgcagctagcaaccaacgctttacggaaatagactcgcacataagcttaatccttcgcagggtccttggaagcttgatcttggcaaacggagcggtcaagatagtggagcgtctcggcgtcgagttgagtctgattggcctgcagggttattgccaagacgggtgggatgatgtttcgtgaaacaatgatgtcgacattatctaggtatctctgctctgcttctttgttgactacattgcatactgccaagccgagcattatatgctcgctcttcgtggggcagtagttctccgcatagcttcctttgcctcggcctcttccaacatggggagggctttcttatccctcatcttttggatgaattcttgaccatatttataccctagattgtagatctcatcaaacttgccaaaatcaagtgtaccatactcatcaattggcggtcgcatgtacacgcatcctggcatgatcttggcgcgttcaagagcatccacactcgagacataagccagccgggcttggatctctgccaaggtaggtggatttggatgcgatgagaaaggattccagcgattgaagaatgcccacacccctgacaacgaatcgccgtatgtctgaggcgtgtcgtcatccagtgcaccgacgtcaatggcgaagataatatcaacgccaagacccttcatgtgagacaccgttagattgtccacataccctccatcgagtaacatgctaccctcatcactcagtggcggtagtaatccagccagagacatggaagctctgatatacctccatgcgtagccgctggtgtggaactcagctcggcttttgctgatattcgttgtattgcagtagtactccagccaaaagtcctcaatctgggtatctccaaaagctttgaagatacctctgttgaactcatgccctgtagtgtacgaggcagaaggatacgtcaagtccaaggcgaatcgccacagacttgccatgcggccagcgaatctcttcgcgaaaccaaacatgggaactatatctgcatgtcgtgcatagagagcaccgacaaaggcaccaatggatgtccccccaaccatgtcgatcgggataccagcctcttcaagagccttgataataccgatttgactgatacctcgtgctccgcctccgcctagaacaagaccaatagatttgccacacagacgtcgagcgagccgatggaagtctcccttgtaaggggtttcaggcgagtagtacggggtatgatgaacctttttcgtcgaggtatatttttggatttctgcttgcagaacttggacccgctccttcagggcctggccgagtttcttcgacggtgggtgaactgggataggattcattcgaaacgccatttggatatggaaatgacctccattgatccacattcgatttcgaagccaagctcttgtcagtcctggcggagatagacgctccgtgtggagaaggacaagcgtctttcgggctgtcgacttcattcctagcatgaagcgttcgtactccccgatggcaggtgatccttcggccacaccgacaagtagaatgctatcagcttgagaaatacatgtttgggtccaaggtgagttgacgttggtatctgtaacattcccttggtgttagcatggcattcttcctgataaatgcagcggcaacatagagagaatcgtttagaaaataggatcaggaaaaaattagagttaacatgtaccatcagcggctttgcctttggacataggagttttatcatcataaaatcggggtaatggggtaaataaattcactcaaagcaaaatgaacaatttcatgcttacctgcaatatacaccacgagaccaaacttctcttcgagatcagcgagatactgagacagtctcaactttcccatcttgttgaaggcatgtttcccaaggtgcttaagaatcgctgtctggtggagggacgtagcaccattaggcgggccgacttgtgcaagtgcattcagtaatcggttgccaaactcaacaacgggaacaccggctgtgacaggcaagatggcaacagtccgaagattcatcgccgacttgcgctgatttgcgactgcaccagcggttgtttctatgccctggtagcttgtaggatcctcaagaaccgccctcatgcgagaagcgatgattttggatatcttgattgtgatattgggatgttcttgggctaagctgttgaagagtgtcttcggaaacttgacaagctccgtgtctctgatggcatgcaaggtcccagcacgagctgtttccgtcaagacttcgagctctccaacactctcgccttgaccaaactcagcacgggcactaatcacacctcccttcttctgttcaactagccgcagccgaccgttaagaacaacgtagatagcatcgctctcatcgttgttgtggtatatgacttgccctgcgttgacctgaacccattccagggcaaagtcaatgtgcaagatcagccttgggagaatattggtcaacctcttggccatggtgagtaggatgatgggatacttgtccacgatgcgttccaaagaagcacgaggtaaaaatccgacgtagacgtcagttttagcaaccacatcaatgaaagaccggtacgaagagacgctcccaatatacccagctaaaccacctggcttgaccaaagccacgcttctgcgatgtgttccggagtgtttctggaactcatccttctcgcgggcagtttcggtccgagccagggttgggaacgattctagtatcgatggctcatcatcattatcaacacccacaaaatcggattctgacgtaggaaagagattgtgaggatcgctcgtgctcgttgtaccaatatcaagaaatccatcgacaacatagtagagaccgggattgcgctcgccctgttccacaagcacagagcccttcgggaagaagacaatctcaacttcgtgtttcatgtcatgggacaagctctgagggctgggcggtgagttcatcgctatgccactagaggtaacggattccgagtcaccgtcgccagggccatcaaaaggacccatgatgccaaaggcattgtttgaaaacagtgccctcgtacgctttgtatccatagccaccaatcttggtgatgcctctatcgactcagattcatgagagaaagggccgccattgtgtaggccaagggccttgaacatgcactctaatatcgatgctctaaacaggttgtcctcatccagtgactcgcgaggatccatgttgatacggcccttttgaggattgaatgggttgtaggtgcgttgcgacagcgggttgacatcgtcttttctactgccgtctatcaatggactacctcgtagatcagagaaagagctcttgttaaatccccgggctacttggatgctccccagcaggtcgccaggccttggagtaggtggggcggcccatctatgtttatccgtcataggagatgcagaactcatgttcatggagtgcagcatcgcctctttgcggagagcgccgctactagaccgccgacggcgaggcgttactggattgtggagcgcaatcccctttgctcgatcatcgtcattgctcttctcacgctcttggctgaatttttccttcagcctcgagagagcgtcacctcgaagaacattggggagctggcaaacagtatgcttgatcatgttcttttcagtctgcaacacctcgccagtcagacccaagtagttgaacgcgtgggataatgttactctttggaagcgggaaagaataacatgaacaatgtgcgacgtcgcctttgggtagactttaatcaatcgacggaaggcgcttgctgggatgatggcaatagttgtgtcgactgtagctcgcgcaatgatatcggggtgagctgaaccggaagttgttttgtgaaacaacctcggacggtttgggggtgtagccccgtccaaggacatatgcggaattctcgacgagttggggtctggtgtagtccggtgcctcatctcgtgatccggaggggggccttgacttcctgttccagatccaagcttggggctcgtgggcattgaggaagaaacgtctggagatccctgcatgctaaatgtcttgtgaaaactgaggttccttctgctatgccgccgggatgatgaatgcgattgctcatcaacgtgatccagtttgacatcctcggtgaagagcgacataatggaaaacaatgacgacatgggggcaccatttcgcacctctgtcaagagctgatatctttggtgccctggattcatatcatcgtcatcgtaaccatcaccatggtcggcagcattggcccttggatccaagcccgatttgacaaaaatctgaaccagcccatcaacaacaatgcagaagcctttctcttcctcaaggttgatggtctcgccagctataagttttcgagtctgcatgctccgggtgagctcatggaagacaggacgctcgagataaccaaatatcttaattgcgctcaaaaactcatccaaatagctcgagaggcccgacttaatcccttcgtcatgagtatccgggaacaggtcgatgtcgggctctttgcgttggggctctggtggcaatcgcgagtacatgttgaggatgcggtatcgcacaacccagctcaccgcggaaacgatgcccgccagaatgaacatcctggactcattgtcagtgagctaccttctgattcgggtggaccgacatacagagtggttgcattcatggtgactgtccagctcgtggaaaacaaggtgaaaaggatggtgggcacgctaatcgtgacaatccgaatgacccagtacaaaacagtggtgatcaagttcaaaagcgacagaataagccgcccaaataagcccagccagctggtggactcctgggcggctgtctggtttgcgagggcgctcatgctggttgaggccaaagcgtggggaacgctgctggagagagaggctgccatctgtgtggcattttctgatgccatggccactccagtgaacgacggagcattatgcacaaaaagagcgacgaagctcgaggttggcttccgaggactttggtttttttccttgtggtggaagaagaagcgggacctttaaatcaagctatttgaggttgagaagctgacatatttaccgaggtgtcgccgctagccaatcaggcaccggtattgatcatgtctcaccgtcgggtcccaccgaaacatgcggtagagatagcagatgatcaaggattcaaggtcacgctgcctcggtagaatcggcaggtcatatgctgggaacaagtctatctcctcgatgcagctaaggtgctattttgtatagctttctgtgcgagctctagcttaatagaatatgaaagcaatgacctttctcctttggttaaagctcatgacgcagaagctagagaagtctcagggctgggcgtgaaggtggtagatagcggacagctttgtcagcgatagcgacggataaccccaccatgaacaagagaacgagcatgaaagaaatgctaactttctgactgcttgctctcctcttgctgtatcttcaccccggaatttcactcctgcctctgtcccatcagatgctcgatctctctgtcatgcgctcctgagaagcttttgcctgtaggcgacctcactccaaccagattcgatgccgttcgcacagctcgtcgttggcagccctggctctggcaagagtacttattgcgatggcagtaagttcaagagtttccagattctgtaactcgtcactgattagacttctcttcacatagtgcaccagttcatgggcgccatcgggcgcgcatgttccgtcgtgaatctcgacccagcaaacgatcataccagctaccccgtggccctcgatatccggtcgctcatcaaacttgaggacatcatgcgagaagataagcttggaccgaatggaggaatcctatacgccctcgaggaactggaacataactacgaatggcttgaggaaggcctgaaagagtttggagaagactacattctttttgactgccccggtcaggtggaactgtacacacatcataactctttgagaaatatcttctacaagcttcagaagaatggcttcagggtccgttgttttcccctcgtcgctaaacgtacatgtttgaaaccaattgctaaccacagcactttagtttgtgagcgtccacctatcagattccatctgcctcacacagccctcgctctacgtttcgaacgtcctactctccctccgagccatgatccaaatggacatgccccacgtcaacgttttgtcaaaaatcgacaaggtccacgcgtatgatgagctacccttcaatctcgactactacaccgacgttgaagacctaggctatctcacaccgtacttggaagccgagtctcctgctctgcgcagtgagaaatttggccgcctcaacgaagccatcgccaacctgatcgagagctatggtctggtacgatacgaagtcctagccgtggagaataagaagagcatgatgcacctcctccgtgtgattgaccgcgcgggcggctatgtctttggcggcgcagagggggccaatgacacgatctgggccgtgtccatgaggaacgagtcgtccatgatgggagcggaggacatccaggaacgctggatcgataacaaggaggactatgaccgcatggaggatgaggccgaggaggagcaagaaaagattcggcagcagcaggccatggaaatcgagcaatcccagccagcggctcccagcagcgctgggatggatcctgatttcggagacatggcggtgcctccagatagcgggatcaaggtagttagaaagaacaaatgataccccctttctctcagtcatcagcatcgtgcatcgactcgtcatctgaatcgcccatggcgtcaagaattacatctggccgacttggttctccaggtgctagtgaagaaggtattggtgaggaagcttctttggcctcaatgagtcgttgcttggcctggcggatggcttcttcctccgccttgcgaatggtgccgctgacacgtacaacgcgaaaaatgcaaggtctcccactcccatccttggttggaacgcgacccataaaggtcaaggccgaccacaacatttgatagtggtctctagagcatcttatgatgaccgtagaagtagcaagagaaagatatttaactatgatatcgggtcagcttaaaaatcaaaagagcccaccagggcgcctggaggaatgtgtccgcctacctgacatatcgctctcgagacaccctgcaccatagtctccaaataatgaagcgacttgagatttgagcgccctgaccagtatgcctggagtgagattctcagtggttggttggtgctgcacgacaagatttggcgtggtcgatttgccaacgcgagaaccctcggtggggggataaatgatgttgaccagaaggtaacgctccttcactcggaccatgatgactcgtaattatgtatgtgagtgaggataatcgcgtacgtggaattctgagattggagagtttgatggaaagaaatatttattcatccagtagcttgcccgatacagttcgctgtggggccggccaactatagaccttgatcatctacaggctattcccatccgcctcacgctggctataaaccttcttctggcatcaatctaaaatcatggacgggccactgaagatcgcaattctcattgtctcgacgactgcggcagaagatccttcaacggactcctcagcccaagctctgcagggagtgatcgagggccaaggacctgggaaatggagcgttgacaatactgccattgtcactgatgacgtttctgctatccagcgccaactcatggctctggccgacgggccagaagcagcaaatctcatcatcaccaccggcgggacgggtttctctgtagcagatgtcactccagaagtaaatgacttccctttccctagcttggcctcttatttaatgtgactattcgtttgaatcgggctctaacatgacctgtataggctgtgaccccgctgcttcacaagcaagctccgggccttgtccatgccatggtgtccgcatctctggcaatcacaccttgtaagtcttcaacgtgaaccacccatcaactagtattcactcgggatgctgaacgccttctcttccctcagtcgctatgatgtccagacctgtcgccggagtcaggaataagtccgtaatcatcacattgccaggctccccgaaaggagccaaggaaaatctggaagcggtaatcaagactcttcctcatgcttgcttgcaagcggcaggcgccaactctcgtgtcttgcacgcagggggtgtaaaaaagctcgaggcagacgctggtctggctggggcgaagccaggccaccaccatcaccatggtcatggccacagtcatgaccatagtcacagccacggccatggacacggcggccttgtcagacacacaaagcctgaccagaaccttctatctaacgacccgagcctgggtcctactcgacggcaccgcgagtccccatatcccatgttttctgttgacgatgctctcgctagaatatcgcgagaatcacccgatcccgaaattctgaccctcaaagtggatgaaaagattgtagggtccgtcttggccgaagatgtcaaggctcgagagaacgtccctgctttcagggccagcattgtagatgggtatgctgttgtcgtccccgaggatggagtgctccatgggacattccccgtagtgttagtttctcatgcaagccctggagaagtcaagcccctgaaagccggggaacttgccaggataactacaggcgcaccgctgcctccaggggctacatctgttataatggtagaggacacaatcctgaaaaccatgactgatgatgggaaggaggagaaagaagtggagatcaatatcgagggcgtcaagaacggcgagaatatccgtgaaattggcagtgatattgaacagggctccgttattctccaaaagggggagcagatattgggagtaggtggtgagataggcctcctcgctgccgtgggagttgtggagatcaaagtcttcaagaagcctgtaatcggcatcctttccaccggagacgagatcatcgagtacaaccgccccgaagaactcagactgggagaagtccgagataccaaccggattactctcatatctgcagcaaaagaatggggtttcgaggttattgacttgggtatcgcgaaagatcaatcgggaacgctcgaggagactcttcgggatggtcttcggagagctgatgtgctcatcactacgggcggagtttccatgggggagcttgacctgctcaagccaacaattgagcgagctcttgggggcactattcactttggccgtgtagccatgaagcccggcaaaccaacgacttttgccacggtgccagtcaaaaccaacgctggcgaacgtgtctccaaagtcatcttttctcttcctggaaacccggcctcagctctggtgacgtttcatctcttcgttcttccctccttacacaaacaatcgggtgtttcccctgtcggcctacctaaggttcccgtcgttctcgctcacgatttcccactcgattcccgaccggagtaccaccgggctattgtaacggttgggggcaatggtcttctatctgccagtagtactggtggtcagcgaagctccaaggtcggcagcctcaagtctgcaaatgcgttggtctgtttgccaggtggtaaaggaaagttggaaaagggagccactgttgatgctttgattatgaactccattcgcttgggctaaattggatagtgaacgagatgagaatctaatgaacaacatattgacgcgattcaaatcatctagtctaagcacaagaacgtccaggatacagattcttcccaactgatacaatttgtatatcatggtatgatattttaagctgcaaaacacaccgtctttcttctgatgatgtacacgtcgatttccgagaattgacgacaatacagcctgcggtagtaagaaataccctaagccaagcctatcccctaaacgcctgtccaaatactcattggcgcgatgcaaaagccttctcacgtaggaaaagcgcgagtagtatctatcttgtcccgtggtaatcgggatattgtcttgaaggtggatgaggggttcgattatttgccgaatcctgtagtcttacccgagacaagaagaccgatgataagtccaaacagacccaggatggaggagaaaatctcaatgacgaggatcttgacaaagctattcgaataattgcagcgttagcattggggactaggattcattcggtgagttgctgatacatacagagacgggtcagcggcatctgcgagtgctgcgccgctgccattgataccaacagcgacaccgcaaatcaggttgcaaagaccgacggtgattccagaccaaaacagagcaaaaccagtatagtatgaatcggcttcgtagagcgcagcgccggtcgcgctgttgacctgggcggaaaagacaatggccatgatgacaccgtagatggcgacgacttcgcagaagatgatggaaatcaagttcttggttcggatacgaggtgctttgacaccaccaccgagaatggacgatccagtgatgaaaattcccctagagagacgtccgtcagcaggggatgcggaaggtttcgatgggatcgcaggcaatgatgctcaccatgcggctccaacaaccgagaagccaatacacaaggcgatacccatgctcgcccaggtatagggcgataccgactctaggaacgcgccgacattgaaatcctcgccgctgccagtgaagagcatatctgtgacgctgtgttaacttgatgctgtccttcccgtcatccttctccatccctgagcgcgatctttcgaggggacgtacaagctccaacaatggtcacaaaggacccgaggccgccgactccgtatgtgaggctcattttgacgaatatgacggtgctgagtcgattcggatgcttcgtgggtagtgggttgaggaagctattcgtagctccttgggtgggcgcaacaatcgattgagcaactctgtctgaccttccttcaagctgctacctaaacttagcgacgtagttcagttggggtacgtactaattacggctcttccgctgcagcacctagcgacgtcacatgacagcgcgctaagacgcaggcacgcacctttgtccgcctaaggctgtgcactgtggcttgaaaggccgagccgagagtggagctgcctgattacctaagcctttggccaaggctgccttctcccttccccggaagtataaattggattctcatcttgactcctacatatcactccccacgagcatcccgtttttgctctcctacggtaccgaaaatcactgcagacgtgaaaggaccttgcaagcaaatatggcgactggcgggcaatcattttacgagctgtaccgccggagcaggtactgcttctcctcttactgccattgctaagcgctgtgctactgtcttgatcccttgcgttgactaactgctgctcccccctgacacagcatcggccttgctctgacggacacgctcgacgaccttatcagtgatgagcgcatcaacccccagttggcgatgaagatcctgagcaactttgaccaggccatcaccgaggcgctccagaagaacgtcaagtgccggttgtcattcaaggtgggacgcgaccccccggtgttgttggcagcacatggagcttgcgcggccaagggctaacgatggtttttcgcaatcgcagggaagccttgacacttaccggttctgcgacgaagtttggacctttttgatcaagaacgtgaccttcaagatggacaacggtactccgcctgtagttgccgacaaggtgaagatcgtgagctgcaacgccaagaagcctggcgagggcccttgaattctgcaaatgatgttactgggatactgggaagtgttttttcaagacgacgattttcttctttccatatttttttccatatttgagacgggtttaaaccagagcccgattgcatgattaaaggcgttttggttttgggttcgcagttcaatgcgttgggacaatgaaacacacacatctacaccgtctgagattatgcggagagagattagttactatcaaagactggaaagaaatatacctgatagtttttacgttattgcatgctcttgcttgcttgctgcgagttcccgtgcaaatttaaggttatcgcctcatccttcccgaagcacctacctaaaattggtactcaagacaaagcctaattccttttttatattgcatgtgaccatcaccattttctacacacaccgttcaatcgcccgcaacacacctcattgttcgctcatttacacgtgggttggatcgacgttatcgcccgccaatacaggggtctgtccacgtaactcagccacctcccactgactcggcttggctctccattaatcagtcccacccgcccagtcctcccacatgacacaggggatcgcaaccgccagggaatcaggagccatgcttcgtcaacgtcgtcctcagccatctaaggatcaggtcaatcctcttcctaccgaaatggccagatcagacaacctgacgggcggcggcatcgcttcctggagcgtgcgcagccagtggatgttctttgccgttgccagcggtgcctgtgccgccttcaacggcgtatttgccaagctgtatgctctctcccaccctcatgggcgtgaaatcgccttctgtttccctccctgcgttgtgaaagtctaagaaatgctcgctctgggtctcgtgagccatcatgtactgatgaacatttgatgatagaacaacaaccgaattgacaaccaagctgtcaaatgcaatcgccagcgggcttggcctctcctcagccgagagaatcgtagagattgccgttcgaggagtcagtaaacccaagtgttcccgaagccaaagcgctgccgtgaggaaagcatccccttgctcaccaaatcaatctcagatattcttcgcacttaacctgactttcaacggcgtcgtaagtgttcccccaccgtcgtcatttcccctccaagtgtatggcatctcacaacctccccagatgtggtctctcttcaccaccgccttggcccgaggcacatcaaccactcaggtgtcgatcatgaacacctccaccaacttcatgcttactgccttcctcggcctcatcatcttctcagagtcactgccgccaatgtggtgggccggcgcagctctactcgtagccgggaatgtcatcatcggccgcaaggacgagacgaaggatgccgatggcgcggcggagaatgaaatcctagtccagcaggaagaggggcaatcggaacctgaggaggacgccgcgcctcccggtatctacaaggatgaggttgtagatgaagacatcgttgacttgggtgagataaacacccaaggcaggtcgtgagtagatcgtgtctcaatgcgggttttagagatgaaagcacgaaaaccttattttagcctattgagtttggcgatgcgtggcgtgtcactgcccgcgcatcacaaagtaccacctttttgtatatacgcccaaaaatatagtttcacgccggtcagtaacatagattgcaagaatatataaggatttgacccaaaatgtattttacaatccttggtaaaaacaaacaagatccacagtctgtgtggacgatctaatgtgtgctaattgcttcgttaacgacggggttccatctccaatccttcgtctacctcatcctcatctccgtccagaatatgtgagtttcgtacagggcgtgagccctgccagtctccggccagcttgatcctccctcccgacatgttctcgaccttctccgatacccaatagccgacgcgcttgaataagacccataactgttcctggctctcgaggatgtggtgatcttccttaggattctccgctgcctcggcctggaactgatacttgaggcaatccttcaccgtgaccaggcctgttagttggccatggtactcgatgagaatgacacgggggccgatcttgcggaacaactccatcactgtttccaacggcaaacgaggatggactgtgaccggcgtagcatcgatgtatcggctaaattcaagagtcgtcgacatcgactcgacattgaccgtcaccgtagatacaagaggcacacccaggttctcgggtggtggtgtaaacacgcatttcgcgtcagggctaattgttctctcacgccgaaccttgtcaattgcatagcgaagttcggtgcgcccaatgaacccgacaaggatgcgtgactccctgtcctcgacaatgggaaagccctggtaggtttcatccccaagtatttgctcgacttcacggacggtcaacccgtgaaccggcagagacacgacttccgtccgcatggcctgtgacacgggcacaccaaagttgtgttcctccttgttgtctaaaaaggggaacccgctaaaccagatcatccggtctgcgatgcctcccttgccaaacatttctccaacaatctttgtgacaccgacaacgatcatggtgggtaagatgtaggtgagggcaccggtcagctcgaacatgatgacgactacagtcactgtgatgtgcatgataccactcagagctgcagcggcccccaagaatgcatatgtacccggcgtgatgcaaggctcgtcaggtttgcacgctgcgaaaaacgcgcttgttgggtgagcttcatgaatggcctggacgatgattccgacaagacgaccaaaagatgcgccaacggccatggagggcacgaagattcctgcaggcaccttgcatccgtagcaaatgatgatgagaaaaactcgaatcaccgtggccaaaaccaagagcacgatatttttgagtcgcttgtcggcgtcgcaaaggcctgcatagtccttggtaccttcacactccaaaaacagaatttccatgccctcggtcatgtcgattcgaaggaaggcgtttggatacgcaataattgccgtgcccaaagtaagcaatgttgcctcacccaccgcgaattcctttaggtatttctttcggaaagactgcacacggagattccatttcatgacgaaggctccgtataatccgccaaatattccgagaacaatataaaagacaatctcaaagaagtgccagtctcgatcgtattggacctggaacatgaccagttgaccggtgcggaaggggttcatagttgatagagctgccgtcgcaaccagggcacaaaagtagctgcgccacatggttttgagggggaaatagttggacatctcttcgagagagaacaacacgcctccgatagggctaccaaaagcaacggcaacgccggcggcagcacttgcgctcaggatttcccgagttttggatgcattgctacggtacttcctaaagagacgggagatgacgtttcctgtgcacacagcatagtgcacagttgggccctccttgccgacggacaagccagacgcaatggcgaggggcaagcagatggacttgatgatgagcgtccaccctccgaggaatcccttcatgacaaacccagcaatgatacatttgatttcggatataccagagcctgcggcgtacggcgcatagtatttgaccagaacagaggcaacataggcgaaaagagtctatgttgggaacaattagcccatgcgtccgcatcggtttataatcgagcttcttactccaaagatcacatagatgaagtagttgaaaggcgcgaaaccagtccagtgcttccactcttcgcatcctaggaaattcagatattagcgacattcaccgacggatgacgctatccaaactcaccgttttcctcgccccagcaacagaagttctcgttcagatagaaggcagtggagcagtatcccaacttgatgtcggacagccactctgtaataatactcaagagggctgcattaaaaccaatcgctattccaaccaaggtgacgacgacccaaccttgtgctgcgtcgtagagctcccataacttatacctccatcccaccgagcctcgcgctcggagtcccgcactttgtctctgtcgcacctttcgtcgggcttgttctctcgctgcatcctgtacccaatctttcccatagctgttagtacctcatgcgatgattgcgtgcgatgacctcgttcgttgatgcatacctattgtcgagaagtcctagctctctgtcagtaatctgattaaagtacagtaactggtcgttccgcaaggaagcgccaatgatgaccacctacctcatatcgcttgatctctgcaatctcctcctccaaatgtgtttcggccggtctgtggccttcttcaggctctcccgattcggcgcgattcacaacggtcgagagacggtggctgaaggagggccggctgtccaagtaggccctggcagagaggggcgctgattgggaagtcatgatgctggccggcagatcatgatcgcaatgcctgcaatatcgtgttactcgggttcgcggattcaatcaatgagcggcgggctgctcctcgttgctgttgagtttggagcttatgaaagctgtccagccgtaaatagattatccaaccatggtaatcgattgtgccagatctgtggcgcaacactgcgtcagttccctccctggagcccccataccttatgcagcactgagctcagccacaccatcttccacagcgcttcgcagacgcgttaagtagcacgcctatagacctcgacatcatctattttatacgacggccattctcgccttagtccaagtgtcaaggaccccctacgcgtccaaattcataccaacaaaaggcttggtatataaagcacttttgcaattaaaatacaactcgactgagagatctccttcaaaatgccttacaacacaaccgccatccctcccaaaaaagagcccactgggcaaacccagctacctcgtgagtcccctagacattcaccacagcggcaaacatgtgtttaactagactatccttcacagtatcaagagtcaaaaaaatcatttcacaagactccgatattaacatgtgctccaacaacgccgccttcatcatcacctgcgctgctgcaagtttcttccccatgttcacctcacacccctcaagggactcacattgctgacctgcaatttcaggaaatgttcatccagcaccttgcggatgagtcgcatacacaagcaaaactggagcgtaaaccccggcgaaacatccagtataaggatgttggtacgtgttagcccccaacctcacacatacgaaaagccgaaattgctaacagccctcaaagccaacgcagtagcacgtcaggatcacctcgagttcctcgaggacgtcgttccaaagaccgtgccatacaaggcagtgaaagcagcagccagtgaaacccaggctcgtctgcgtggtgagaccaagactgacgagagccaggccgccgcctctagccagtccccggccgccaccacaaacggcaatgcccccaatggaaagacggggaccccttcggcccccaaggctggcaacaatgctgatgggaacccaagcgaccagctggagctagaaatgaggcaggcacatgggtcaaaacatgacgcggacgttcaaatgacaggataggatggtcatgggcccttcgtcatcaacttgcagcgtaatacttctaaaagggcgtgaaagtagtgcacaggcgttacgtttttcttcattattcaccaactaaatccactgtcacaactggccgactccctttccagtgtctagaccaaaaggagaccccccgtgtatcaaagtggttatgtactctgaaagccaatgcaaaaacaaccatgtcctaaagaaccgtaaaccaagtccctcatacttgttccgcccctaataccgtactggaaaatgtgatgacattaaactccgaggctccttgatctattcttccatagcatcggcctgaatacctgagggcagccttccctcgttgagctccttcgaaagagcggtgatctcttccaaggttgtggcgttccgaatcctctcctgaagcttcttcttctctgcgtccgtgagcttcatccttgacagtttcgatggcgccgccgatccgtttactgaaatgaccgtcgcggtagacttctggcccatgatctgtgcaggattcctatgtcagaagtgactccaaaaaggtatatgagattaggggggaatacctcgactgccagcggtgtcggttcatcgagagttccaaagagctcggcccccctctctcgctcagcttgctttaccttgacataatcaaggaaccggatggtagggcacagccaaagaacccagtaccgataattcttcaacgcgcaaggttagacaaggagttagacatacagtggcagagaaacgccgtcctcggtaatgggcagcgcactcacctccttcttcgcaacagggttatccgcaagaaccagatgcgtcaagtgcgaaaacttgcccagaggatccaagtccgcgagttctgccaagttgttcgacgataaaacgagattcttcaggttcggtatagatgtagccagcgtgttctggatagtcaccactcggttgcgtgccagcagaagagtcgagatacgcggcgagagtgggaagttccccagcacttggatatcattgtcggtgaaatcgatcgcgtcatgagcctagccaaaagttcaagtcagccagataccctagggtgaattggcccggttccaggtccggtttccgctcgaaagcgagggggaatactcacaccggcgacacccagattctcgatggcgggaattcggtgtcctgttaacgttcaaaagacgaatttggatcaactctgctctgcacaagatcaaatagtgtagcatctgctcttttcaaacgcacctcgtagatcgagctctcgctctttcagcgggttgaggtaggaaagggagtcccgaataaggtctgtcgtgagcctcatcttgggatgtcgttacctcgatcgctgcacgtgggcacgcgacgcctcgctttgggttgattgacgggtctcgatgggaattctagggttcgcgattcgttcggtgcatcaacgctgcccttaactaactgatatagatctggacaaatactcgggcttggctgtttcttccacaatgaatgcatcctcagaccggaaagcttcaagcttctgggatctgagaatttttgtggggcgatcatgcgccactcactgatttgtgcgccacacttcgagaggtcctcgtttagataggacctcagctcaacgaacaaattgtgtttaagagcaaactcaagagttattttgtttatcatttctaagttcagaagcccgatgaccataaatcgtttactccacgtttctctactcagaggaataacaacccaggtagcaatagctgcaggatctctattattcaaatctatccgatcactccaaatatctattgaaagacaaacacaactccagatcgatcaacagagacactcattgtataagggtattctaaaacaaccacatccagaatcagatccagatgcgactgcaagagttgttgttgctgagaagatatgaccgttgacctgggcggtcgtccggccgtcgacggtttgtgattcttcgaggagttcgaagcagccgacgagtttctggaaaaccgctctgtagtgacggtcacacctgccacgggattcgtcgttgtgtatgtcggtttcggctcatcttggctgagcccgctgtatatgcaagaactctccaaacgggggatattccaaaatctgagtcgtctatcagagccaccggtaacgatgtaggcatggcgtatatccctcgagtcctcgcttgcgccgacacccacaaccattgtccgaactcctttgtcggagttggtaacctcgttgctctcaatactcgtagcgaatcgcctcagcataccttcggatttgtcgtcatcgacatcccaggcctcatacactgctggcccgtccttgctactgctaccagtacggtagacttctctgcatgttgtgcgctccagatcccaaacagtgacctcaccttgtccggtgcctccagacacacaaacccacttccctcggcctttagttgggtggatagacattcggtagatgggtcctttccccggaaccccccacgccctgagcctcattctaaatcgcagatcccatagggaaaccacaccatgagaagttcctaagcaaagccaattgcgtttcttatccacgcagaagcaagttggcgtcccatgatgaacgggattctcgaggacatatagaagtgacatggttcgaagatccagacctagaattctcgatcgattcgtcgcaaggagcagagtcgaattcgaatcctgtctaaaatgctcacaccatgtgacatattcttcgtttgggagtcggtactcccgtagcattcgtagttttccatacctaaggacaccacctgcgggtaccgtatcaaccttcaccacgtggacagctccatcggaagcacaactaacaaaacagtgcgtgttttcaataaaacacaaagctacaatacgtgcgccttctgcgtgtttgtacgtctggcgagagcgatgggatatattacgctctaaccgcgccgagtcccagacctttacagcgccatcatgaccaccggtgatgaaaaacaaatggtcaggtgaagctacaactcgagcaatgggtccagtatgctctgagaacgtggccacaaccttgccttcgggcttccaaaggccagctccttgttgagcattaacctggtttgccttcgttcgcgatataggctgcacaaacggcccgaattgaacgacgtcgcgtggaaagttatcgaggtacatgttatccaacattctctggatgttgggatctgttccttcgtaactgtgtttggatatcttcttcacaggaagaggagcttctcttgattccatggtatgcggctgagcgggctgtccttgggcgaacggtccttcgacctctccaaaggcatccgttgcagtcatgccagtttccggaatggatttattgctatccttccgatctagaagactgagcgcgtttgatagaagtcgagttcctcgtcttgaatcaggtgtagaatccccgtctccgtttgatccctggcttgcagtattgtattgcaatcctcgggtgtccatcgagcttgatcgtccagcaccaagaggcgacaataccctagatgatggccttgggcgtgggccaacgctctgaactctttgtctatgattattcagcgaagctcgtttccttttgctcgccaagtcatcaatagtcatcgaggcgtctaataaggcatcggcgatagtgtaaggctctgtttgcgatacaagctcggcgaaggcctgtggatcgcggagtggcgtctcatcaaagaaaactgtctgtggcgtgacaccaatggccttcaaagacacgattccgttttgcgagacgttgtttccagaaaagccatcacgacttttgatcttgctcagacggtagatgaattgccgcagcgcaagtagtttcggttcatcctcagacttcaagcccaaatttctgagcttcattaaccactgttcatcttcttcgttgtgcgctgttttccctgttgcagagcccaagaggtctttggatgaacttgcgccgaggagtctcgaaggcaaggacctggcctgttgggcagctttccagaagatgcctctatctgaggtcatggcccatgtcactgcttggtcaaacacgggccgcgagataggtctcttaagagaatccagcaagttcaactcggagaagtcccatataagatccaccttcagatatggtttgaccacaggcatcaagatgcaccgcacatcggccggatccaagtactttgttgacagtgcaatgaactctgctgccgattcccgtatccagatgttcggatgcatcgtgaacctgctgataagatctacgagctcccagagcttgggtctggataagagcccgaggcccgccagctgcgctagggaatgaagcgcagcctgaaccacatactcttcggtgtctgtcagagcctgaatcatgagtggcaacatgaactcttccaaactcttacttccaacaaatgttgcaataccgacgatagcgtcaaaaaacgcacatttcagtgtccagtcccgatcatttaggtaggtgatcaaatgagtcaacaacacatcgttagaactctcctgaaagaaaacgcatagctccgggactgaagccaggaatgctcgccgaacatatacatcggggtcctcgacgagctgcttggtatggttctcaagtatttcgtataactggctgccggcattatcaaaaataccctcaaagttagcctcagcatccatgccaggctccacttcggggtctgtcataggcatggagccgtctgctctgaggctagatgccattgcgagaaaacgctttgatgtagtcgcgaggcttccaatgcatgaagcatacgaggcccttactaggggacttgaaatctgccatttggatcccaaggcaatctccatcctgggaaggacgtactcgaccagtacgtgtgaattaataggggtgacagttttaacaagttgtaaaagctgtgtgatggttcttatagcagtgaccatcaccaggtccgtttcgtccttgtgtagaagcgtcatgagataaggaagcactcggtcaagctttgcttcatcggtgatcctttccgagaaggctagtaagatatcacaggctcggatacgagacgagacccgcgccgttgtcctcattgatgatacaaccaatgtgaggaataggagagttccgtcatcctcaggaggctccaggtcagccgagacagaatactcgtgattaggaatacccaaacgaacagggaagtggttgagccccagtcttggaccaagttgttgagtatcagccttccttttcccgtcttgatacccgaggaagtaagaaattttgtcaaagtcgtagtacacgcgatctatccggtcgtccgactctccaaggttcttctgcgcgttcgacatcatactattcccagatgacgggtcggtgatgagctccatatactggtggaggaaattgtagaagtatgacggaaagactttgtctttccaaaattcaagatactgatcagcagagtagcgcttttctggatcgagctggatcatatgggatatcatctcccgaacgtccttgtccgagatgacactcagatgggtaatgatgggatcatactctcctctacgatatttatacagctgggcgaggctgaatatctcagtctcgagaaacatctgggcaattacacagccggcactgaagatgtccattgcccaggtcatgcgcgccttctgaggcggggcctcgcctgcagcatagaatcgctccggtgcaatgtagcatgttcgccggccagaagtatcgaagaagtatgaaaagtctcccgggttgtcgtccgggagcacaacaggcttaaacgctgacgagaaatcggtaaggtagagccagttccaagaggtgacgagaatattctgagccttgatatcgccgtggtaaatatcgcgggcgtgacagtcgcgcagtgcgcacaggagttgaaacgcaagccacttcttttctatatcttcgaggaacggccgagtgctcatccggtcgtagagagagctatagacgtgctggcggacgagataaccgttggtctcagtttcgattatgcgctggaagccgagggcgttcggtacatcggccagagccttccgttcgtctataaagtagtcagactgagtccgtatccatatagttcaaaatatgaggcaccaacttactgattatcctctccttgtatttatccagtttgacttctgtgtatggcttcaccagcactttgacaagaacgacaccttgctcagtccgtccgcgaatacttttcatgaagcgcgcattcccaatgctcctctcgtaatgaacatcgcccaactgcggaatatctatccctgcggagccggcagacggcgtcgcgagggagaaaccttggcccatggtcgtatgtgtgggtgctggcaactatcaaccagtcgggaatcgtgtaacggtcatggcattttggggcgacaaggtaggaaagcccagccagagggatcgcgaatgccgaactttgtatgagcgagggtcaggtagctggagtcgatgtgcgtgggcttggatgtcgttgtatacgaaaaccttacgtcggcgtcgcagtagtcggaggtatgtcgtcaggagcttgccttgccaccagtggaagctgttggtacttgcgcatagacgaggtacttgcctgaggtgtgggggtgaggcgggcttaagtaccattttggtacctcaaagcccaaattgggaattacagcatgccgtagtccagccatcacgtgggtcactccttgataagatacaagcgagtacttcgtggctgggtcgtctgtcaggtaacggtgtactttcttcagtcaaccgctgccacagcctggcatttgtttgcacctactgtgtacctacacaaacaaataaggcttcatcctaccgcgcatatcgttagttcttgttcaccatcgattatagacccccttgaatctgctgatcgatgtttgattccattcatcacacaaccgttgtagcccgacgtctttcacatcttgacaggctctgctcttactgagatgatcgtatgtatgtatcaatgtcgaaacttagacaagttccaaaactacaatatcctacgtttcatatatattccggtgattcccctgcctgaaaaggtacacccacctaaccaggtcttgttcctgctgagtccaatttcaaaaatgtccattccatcccatgcgatctgcccattatatgcagcaaaatgaacgagtcgctaaagccatgtccaaaagaaagataaaaaaaatcaagtcataagatcatccgccatgctgatttagagcttccgctccaaagaaaggaaaacaccaggtaatgtaataagatgacatgaggtcttattaagatatgttcgttgacaaagtttcagaatccatctgtggccagactttggttctgttcttttcttcttccctccctttcttccctttttaattctgtggcttttcggatgtgttaaggaattcgtcgttattcacacatttcgacgcatcgcccgcgtcgagcggtattgtaatttgggtagttcgtagtccacagcaataccttcatctgcctccaaagcagtgtccacctccagagtctgtggttggagggcgggctcgatatatgagcctctggggttcgaggacgggagcacctcggcgacaagcggctcatcgtcctttgcattatcaccatccttggaagcgagctgctttctcatactgatgggccgatgagtgcgagcttttatcagctcacccgtctcttttgcaagttccggctcctccttttctatccgctccatctcagcttttgccatctcgtaaaccttcaagagcctgctctgaatattcttgatctcgtcgttgcaatcagcatctctcaagaactgatgcgctccatgctcacaagtgccttgcacaaagtccaagcccttgtcgagattgtcgtagatatctggctggtcattggcccttgaggggccaaagccgggtcgcgaaatgcctcccatagcaccaaagcgtcttgagctcgcataacggagtgagggaagagccgtttcaccatcctcgccttccaagttcccctcggccagttttttaatctgcgcaaccttggcggccatcttggctttgcgcatcaagtttctactagaagatgtaaacctcaccaactcatcgaagaatccttgaacatagctatcatagtagacaatgatcatgcttcttgtccgatacgtgggcttcacagttccctctgcagaaaccacagatgatggcttaagcctcttcttggcctgcgctcgagcacgctcctgagcagctttgatggcttcagccgtgttctcactagccttcagatcaccagctgtcgggtcggaagatgatggtcgtggtttctcggtggtgtctcgtgggtttctattcactttgggagggcgttgactttgtttaatttcggagagctcctcgggggcgggtatatttgatggaccgtcgtctttgggtttcaaagactctgtcgaacccttatttctcatcgacctcgtctcagcattgacatcgttcttggccagggcggccagttcggtctggcgcttgtcgatctcaccactcaagacatctaaccttgaaagccacccaggtatgtgtgtagtcaggttcctcagtgcatccatcgccatctcgcgcggatctgtatcacgcggaggcgccgtcttgaaagcttggacagcgagcgtcaggtgcgttttcacctaacgtgctgtagaaaatgcagagaagcgagaacgccgacgatctcgtcgatggaaaaatgacaagtatcgtccccaatacgaaagtcggggggaatccgttggggaatgcgcagatcaattggcggcgcaccgactaagtcaaagtatgattcgagaccaaggactagacgcaagggagtagcatacactgcccagcaagcattctccgaaaagctaaagtagctatcagacgaccagcccgtgttcaggtagctcaagaggggaagggccaaagcgtagcctcagcaaatcgatctcctcgaagaaaaaacgcggtatcgtacgaaattggcctgtcgaccaagtgcgcgcgagtggtaggtagggatttcgacctaaatacaagaataggagggtgcgcggtcgtattaataatattgtctatgttggcaagcaaacaaggttctgctggagctgccggaggtaaggtccgcagcgagactgcaaatattggcaagctgttgttggtcgtatcagggccgcagattgttggcggatagcgacagtcgggtactgggacggtgtgccgggccgcgggggtctcgatggtctgtgttcgctaggtctcctaggatgatattaggttatcagtcggtgccacggtttcttcattcgaggttcgtcaacagaggcgcaagacatcggccgatgtccatcggagaatgagccaaaaatgcgaggaaatgggagcaggatgggggacgtagaagttttgtttgcacatgcgtctggaggtaattgcgaagtaggtaggcgggccactgggaaccggggttggctgctgagcactacctaggtatctcgtacccataggctattgcctatcaattcggtgcccaaggcaattagccgtccttgttcaatccaacggagaatgccaaggtgcaggggccggcggagatggagctggcagcggggcaagagaagcgctacttaagggtacatccgtcccccccaaacttgcagtaggccctaacatcctggaccggtcgaagctggtggtgcataagtctggatgcaaagcgccattcgaagagtgcggctgtggaaccagccagctattcatgtacccaccacccgtcggatgccctccatcacttgcagtgttcagaccacacaagctgtgccggccatcgcgagccgagggttgcgagcataccgagacagacagatgtgcaggtaaacgctcgagaggctctggagcaggaagagctggctggctgccttgccgggcagatggcgatactatcaccaagtagctgaagcatgcctgccctccattcagttaattcaggtaagaaacccgcgcacagaaaaagcacacacatggcgggagcgcaaggcactcccagcaccatgccggggatcgccagaacaagccaacgtatcatcaatctgctctcgtcatctaccacacaacaaaccatggctataaccgcttttcccaaagaagccctatgggtagcagacgaatgagaattaagccgactcgtcccgttgatacataccagcaaaacgaggtagcagcgcctcaaaattacgtcggcgacacccccaaggatgatcctctatccgtttagatagaggggagccaccaaagccacaggagcgcagcatatgcacgcaagcatgagcgccgtgccgtgggcattatgtgcttacacgccgtaatgaagcagtttcccaattgcgatacttccccgacgcaagatcggatcacaagatgccttccggcggtagcacagcggcgtttatctaggatcaccgtgccacacctacattctagcctcatgcacatatcacagacagcagttatgtacggatacggaggatgtcgtatccaaggcattcagccctcatccacatgtatgcaaacctagttctttcagcgtgtatgctcctctattgaattgcatgccaattgattccatacccctgtcgggcatttgttgtcgacatgtaccatttggccgatcatgatttcatgtcatcactttgcccttgctttcttcgggcaaccctagcgttattgcggtgtacacgaacaccgaccaccttcggcgaagtggttgcctgcgtaagtgctttacctagatatacatatatcgtgcaacaggcgcgcaactctgcctcattacggaaagcgacatatgcaaagatgcagtggggacgacattccgccggtggattctttatactagcacataccaaactctgttcaattgacagatggactcgcaagatgctctctattaaccccacaagttccgcttcgacgttccgcgctctggtctccatcgctcctaagaaacgcgtgattgctcaacagagtggtatctggcaagcgcctgagtctgttgctgtcgaccaggatctacaaagtacaggatcatctgttgccggtgtggttcggttccggaagcccgtcaaggggacaataagctgttggcgttgtcgcccggcctggcaggataacatgcatgagatagtcggaagcaacaggagtagaagaatgccagacctgtcggggccactcctacgtgcatacaggcctggcccccttgtgatcgacctgcagcaggagcacacatcaacaggcagggtgctgtgacgcggggttcttcaatatcgacaccgctactcccgcccggaatggacgacgacgactgccggacacatccgccgaccccaaagctccagacggcagaggccacacacagaattctgcctcggcgctgacgataaatgtcgttgcattcatcacctgtgtaaccctcggggatgatgtcgtgagcaaggcttgctattaatgtattgactgcatacctgcatgtaatatagcatcgctggctataatacatcaagtgaggatgtatgaggcgccatcacctgatctcaacaccaacatcaaacaacaacctatccgttggctgttaaagcggatcgcacaccacgagcgtatccgcttccattgcacccattttcttgtcctggcttccagaaggacgctatagtatgtctgcgtgtgcgacaacgtcgaggtgtgtaagatactccacttggagcgtcataagtttcaacgtctcgcgggggttgagatgcaggctaaacgagaaccgtattttcagctgtcgctgagagggccccagttgccgggtaggttctagcgagtcgcaacgccctgcaacccgagctaatccttgaccaagtaccttcagatttgaccagcactgcatagatccgccttggatgtaactacatatgtggtgcgcggcgcatgtacatacagtgaccaagctcctcggcacgacatatattaccatcttaggtaaacgagtcttgatggggttggcgcacgcgaggaaccccgcccgtcaagcgaaagggggcaaggttgagctaagaggtcaccctctgggtgtctttacatgttcggatgtacagtgtatgaacagggaacgagaaggatccctccccatcatgctggggatggacacaagtaaatgaaaacgtggtagatgcttgcgcccgttcacgttcccggttcggtccttacccgtcgaggcccttcctatgaaacagaagctacgagttcgagtgaggaggggggaaaggaagttcgcctcattccagatcagattcatcaatacgccctctatcttatccctgtcgaaggtcatgcatcatcctatgcgtacccaggctagagaggagagacctttgcaagcttgagacaagactgtcgtttatccacgaccgctattaacacaaacgattgtctcgaaacaaagcaggtcaaataaccacatgccggaactgccctcatttttgagcctctttatctcgtctatcatgcgggttatcaacccaacccttgccctagtaattacagaatctcggccgttaacccgtctaagatttgcacacaacttgatcttcggagaaatgtaaaattgcgggtgtcaaaatgggccacacgacaaggccagctcgtggcaagctcgtcggccagcccccgtcggctgtcgctcgaggcggcgtgagtgacgcatcgtctctaggagcgaatcccttccaaattccatatcaacctacatgggtttctttcctcgagcttgcctggaacttttggcgatagccggagcatccactggcaaccagggttggcataaagactgcgggcgcgacagcttcacctccacctgctcgcaactccgtctgtcatgggaggattgaggccgttggcgttgatacccagcccgctacatacatacattgagaggaatcgcgcggcgaatgtctgcctggtggcgcgtaggatccttgcgctagcctctcatgaaaggattttcctctcacttcaagccttggactgatttatcccatcacaccaccacatggcaagcctgcttccacctccgcctctctaactagccacggtaagacaatatctccactcggatcgggaaggatcatacgcgggcattggttcaagggtgatgccctgaaaccaagtgggctagactgttcatcaaccagaaggtacttgggaatacctctgtgcgcattcaacttgttgtgcgttaggggacacattcgctggttgatctctcacttgtgttggtgttgtcccttgtctctgctgatactccgaacccccaaccctccaccgcagttgtcccattactatctcgtttaattttccctatttcacttgattctttttgtgcccagcttgcaattggagtttctcgtccctattgagggttgtcggcaacttccgttaaatcgctcagccgcgatgagggtcggccgcctgtcctttaaatagtttcggaattctcctcataaccagacaggtcaacagacaacatcagaacaaagcccgaccttaccctcccggtctctgagttattatcagtgtctggtgtctgccttacctttcattggcaggtagtaagtttttagcatagtattactactgcccttgtatgggcgcattaattagcacttgagagtgacatcgggaggtggggtcactccgtggaactccgtgaaaaccaatgggcttttgtccagacaattcaacagcctgctctgctcttacgagccagcttcccagggatcgatcagcgctgttgcctataccgtagaccgcgcgccatgttaccgcatcacggctacgaggtgccagactattgctcagtgcatcacgcttgtcctcggaaggcagccgcgggagtcttcctcagtctcactttggccgcaggctgcatgtagcacaacgcgaccagaccatgcccagggggagttggtggagagcggcgggggaggggttgagggtttgatcgcccaggcctcgaaacgagtcgcgaatccgctgtcctcgagggtaaacggttgagcgttaaacctccactcacaatgctcccctcgtgcattcccgcctcctcccaactccgcccagtcctgttctgattgaacttgcatgacaagcacaacgggtttctgcatgtagacaggtctgtaaacacgtgtctcaccgaccgcctgttgctctgtcgcgctagtagctagaagatttagtagagtaggatagtgccatgcagagaaaagtccaatgccgtcggcgaactccaagaccgaagattcctcctcttgatcgcatcttcttgcctcttgcgtggagggggtgcgagcgaaagtctgccgtcggcggttagctgcctgtcgcccggcgccctcccgcagaggagaccagaagcggcagccccctccaaggccctgcatgaggaacctgatgattatgcaaggccgcgctgcgggcttgacgcagagataatttaaaccggtcatgccaacgtcccaatatcttcgacgcaggccggcgggtgaggctgggccaggccaagccaccaaacgggtgaaaggcccggcggaagatcaccaacggctgtctcagctggcacgatgctccgccttggttggctggtcttcgagattgatggtgtagggagaggatattcatgctcagaatcatatgcagccctatgcagtcacacatggccgcgcgttgttgtttttctttttgttcttcgcagattgatggacatgataatggcaccatcaaagtaggtaggtacctacggtgattcatgcaagccaaggatgaaatagcatgttggtctcaaattcaccaacattcatgattgaagcaggataggggttcactctcaaattaatcatagaatatgatctcaatatgccgatgcccttgtcatctctctcctcttccctcacggccggtcaatacctaatctggagcttgagctcatactccagccagcatgacctgggccccagttgaagagaaaaaagcaatgttcttcatgctaggaggaatatgagacacctttattggataatcttatttgtgattcactttttttacatgtctcaaacacacgtgtttgctgtgtttctaaaacgattaccagtctcatcgtctctgtcttggtgacgcattttcctcgcctcttcattaccttccgtaaatcatttgataacataacatcctcccccctctatcaagtcattttctgtatgctttacagctatcagttaaggagtacaggtcttcataggttgaaacaagtcaaacaaggtcactcatatcgcacaagcgtatatttcaacacacgtagcaaacgaaccctcctcctccgacagactcttcaatgtatccctgatcaaggccatagctctgccgacgtccatgtctgcgattctgtacgctggtaattccaccgtcgccctctatccggatccgtgagatccacttggtcaacgtcgtctgggacaataacgagaaggcgaaagtgtcgtctcgcaatctcatcctcaagatcttccaccttctgccccaaaccgtacccctcctccggcttctccgtgatgggtcttccgggaggtgggttacggaaagatcctctcatagtagggctaaggttaccgaagtgagcggtgagctccgttccccagctccaaggaccgtctccgatgcgccgcatctgatcttccagtgccttcctcacgggcgctccagcatccgtgtcgatgtccggaccaattacgtacgcatggccccggagccgccattgcgttttggtttttggtacccagaacacagcctcgacaggcccccctctagcagactgactctggtggttttgggcggaggaagaatgtcccaacaattcggggactttctccatgcgatcgtcggttgtgagggtgagcaggtccgactcccatgtatccggattcagcttggccgagttcttgggattggcatccattccacccagcatccctcggaagacgacggtgcgggccctcggcgcgagcgaagagcctgcggcagaaaatggctgctcattggagtgaagcgtgctcaggttgaagatgggcgcctcttggacatgcgagaggaactgagacctccagggtgctgccattgctggagatgtgcgagccaggccgtgctgtagatgatgtcgaagctgcattgccctctcggtgtgggtatctagcgatctcatttgagttcgtcggttgcgagaggagcggcaagtcgcttggcttaatcatgtaggtagaacagccaaactagcagcacttgaggacatggacatcatcatattccccacctaccccagaatcaggccaggttggggactactcaaggaataaatgacgcggttactgagtacttacacgcgggctttacattaagatatcgaggtccatgcctgataagatttttctctttaaatcatgcctgtatttcaattggacgtaaactttggcggctataggttgatcaacaatcggaggactcaatcacgtcatagttctgctgtatggtagcacatgccttgtctcctacagattccttctgtccagtaatcacgataaatggcagtcgattattcatcgatattcaagatgggtattgtcattctactctgccgacgtggttggggttgatgaaatggcatcctgattggtgtgtggcctacctcgatttgtgtgatttggaggtaaggaatatctaccccaacccctcttcaccatatctgcaccgaatatcggaacgggcgtgaatcatacgaatagtgttgcatttgccccagtacgagacgaggacccgctgataccaagtctgctgcgcacaggtttaacctaccaagtgggtgacaaagcagatgagacaccaaaaaataccccgtacagcaatttccctcttacaacctctcctttttcatacacaatggtcggccaagagcataatacgcctaaaaaggcacatattagaggcgcttttgaatatcttgaagctaaaaaaatcccctattttaaaactgacttatttcaacactttgaggtctcgcgagcgactggctatcgtatcttagctgaggattcaaaccgaacacggccgaataagcctacacttcctcccttagctgggcgtaagaggaagctctctgaagttagcttagataagctagaggacctctacgagaaggagggatttgaagctaaatctctcccttggacagctgcggctattgaagccggcattgaagaagacctctctagccgtacgatcagccgtcaagctgctagccgtcagatatttaagcggctagctgcagaggttgcctttactactgagatccaagcccagcggcggtttaattgggctgccgaggctcttgccaaccggccaaaccctgaggattggcatgatgtgatcttctcagatgaatgccattttggctatggtgatgagggccgccgttatatcgcaaggaagtctggcactcgatcagatccctcaaatattcaagagcgaagagagcctgaagaacaggataagaagcgaatacacggctgggcaggtattggctacttacagacgttattgaccttgaatagtagctcgcggttctgtatatgtggatcgcgatctatctcattgcgaataagctgccggttctcttcagatagcttcctcggctgccctgaccgcggcaggctgttattatcaacgcgttgagcctcgcgattgaccgtagatcggatagtgctaagaggtatctctgggaagagcttatgaatctcacgatacgaatagccacatcgccttctctcgcagatccgtgtacgaacgtacggacttagctctttgcctcgaggcattaggaaaatagctgtattgagaggtgctattacgatgtgttgagatgtgaggaagatgatgtgaagaacgcaaaagcggcatcataatactcaacgcgttgcaagggggtgggcaaatactaaatgactcccactgtatggcgtttagcttgagtgtggctcagataagatatctctggaataatccaggtacccactagattgacatggccaaaccctgtcgttatcaaggtagatctttgactcgtcaaggccgagttggttttggcctaatgcataatttatctctggtatttgctgctgctgatctgtaccgaaagcgaacggctagtaccacctatcctcatcagatggctcgtgactgagactcgctatgttgcatatatatcgcgaattcatttgagataacaccagctatctaatctccacacaagcgtgacctgtcggggaaagctgcccctgttgtctacgcaggacttgccgaaaccccgcattccaacctggcttgggaaaagcttgacaccatcggaactcccggctgctggcgttaatagcagggtgtaaccgactctggcctgatcatgtctggcctttcatactgggcatatcttaaccatttgggcgaggctacgggccatgtcggccagaacagctcctcagccgagcgccggtgggcggagaaggacatcaaaggcgtaagtgtctgccctccccatgtttgaagaataaattctgccatctgacactcaatccgtagttgtaaaagatgtcacgagcagaaaattcggtgcaatggcatcttcccatgccaacaatgcagcaagagatctctgccctgcaattttaccagctcaccttcagcgagggttgccatgaagagaaggcaagtgaacgaagagaaatctccttgcatccttggcgactggctaaccctactcaaaatccagctatcaaaatgaaagaccgactcccaatcaaccgatcggcagaacccccatctcccctatcacgatccagagtcagctagaaagcccagagacaggtgcgaataatgataataagaatggttggagacgcctggcttataaattccgagaataggtcacttcagcggttcatctcaaagaagcctctccttcttgagccgctcactggacaccgcatcagacctttctcctccagctatcagatcaggcccattagaacaggctctagccagcggatcagaggagccactgacaaaccctctggcattttatacggcaaattgggttcagtcatcttcaagaaagctgcgtacgtcctccagcaccctcgtcattcctctcccgatcactgatagccaaactagtgtttatgggcacatcctccaactggtccttcggacgacgagtgctggccatgactcatgagcgcctcacaggggaagaactaccccctgataacctattgtttcatgacgatgtatatgacttcggatggaacggagttagatcacaagcctcgtcgcctgacaattttgacgactccgtgctcccaaccccggactttgctgtctacctgataaatgcagtgaaatttcactgtggaggattgttttacctttatgacgaggattcttttatgaatcgaatgagtcgatttcatgaaaatccttctgaatactcacaaaggtttcctttgtggtatgtccagtatcttctgcttctcgctttcggcaaagcctttgcaacccctgccgtcaagtcgcactggcctgcgggtattgaactattcacacaagccatgaaagtaatgccggacctcacgtttttcgacgccgaccccttggagctcatccaggtactctgctgcaaggccctgtatcttcaatgcctcaaccgtcgctctccggctcatcgcacggtatacatctcactaacccgttgatgagaactttttgtgctaaacagtccaactagattggcaatgctctccgacttgcccttgagaatggcttgcatactgagatgtacagcccgcttcttgacgccgactatatccgaaggtgccagatcatgtggtggaatatatatatattggagcgacagatgtcttctcttcagggcattcccgccggtataccagaggaatgcatcagcaccccattcccaccaatggctggcagcgcactgaaaattcaagtcaacttgtctcaaatattatccaaaattgatcagagtaagtcaccgtgtaaacgatcgggggcgaatatgctaacaaagacactagctgtgtatggtgctgaaggcaagattggcagtcgatatctagaggccactcgatctgtactcagagatattgctggtgtggccgagcaggtcaacaatgtgttcaatattcaaacaaagaaagctttcaaaggaatttcccgtgtagcggcgcacatccatcttcttcaacatcaagtgtgtataatcggccagccaaactgtccggtatcactaaagctgacttaaatagtgtataataatgagcaccaggccgttgctatacatcttcttacaagcgaaactcgatagggctgataaccagttgatgcggtggttgcaatctgaaagcatcaccggccttctcaacatatgcgttgagtcatcacagcagattattcggattctctggtgcctgctcgaccaaggccttctaggttcatattttgctaccccggcatgcgtgccaagacgtcaatagaatctaacaagaagtgatttagagacattccttccatttgatttggacgccgcctttagctcaacaatcgccatactaatgtcaaaagccacccattcatcgttggtacaagaccacagtcactggatagatggagcttacacgataatttctgagatgagcagccgagggagcgtgattgctgggatgatcaaagaggaactaagacacgtggattccaacttacaacaacttttatcgaacggagatgaatccgtaggcttgaccggtgatattttccaagagggcggctgctctgatgaggcggctgttgaagatagtcagggggactttgaaagtggcatgttcagcagttcagatttgcaatatgagcttagtgccgagcaactcatttccgttgccgatgctctcgatttggatagcctggcttggatggattcacacgatgcagtttagtgttaagtgtgccgcagacacaaaaatagcccgccaggccgccgagtctgagtattttcagacaaagggttattgcgtagcaatagtaccacacacaatcacacgagattgaaaatacgcaccttattgatccaacaagtactgtttttagccatgtccgttcgaatgtaacaataataataacaattaagcccaatcaggataatcctgaataaacgcacccatctgtcgcattagtgatatatgacgggcttattctagttttccaccacccctttatcacactaaaattgcatcaaaactcagtagtgaaaatttgttgacttctttctaggattataacctctcgagcgctcagtgtgatcctactcgtgcccctgggaatcaactctctcccagctcgtgactctcccgttgcgcgaataatgattgtctcagagacttgacccccataacaccaaactggtctcaaaatcatggactagatcagactcttatggctaccatgctataatggtccccccagaaatgtgcgaagagatttaatctatcagacgagcatagtcgtccgttccaagtatgatcatgatgctgctttgaatgaatctgagccagtggtttcgcttaggtctcttgatatcatcgtggaacgaagcattgtttgccctctaggctccgtcgcactcatcttaccaagacatagatacacattgagactactaggacaagaatcctctaccttctggcagggattaatcaagaacagaccatcactatcagtgctcccggctatcggccagttgtaggccgtgttgagtcagtacaaccttgcacagattttcagctcaaagaattgccgcgtgtccggcccacgtcggggttgagtttgtgcctgtggcaaccccatgtcttgtttcccatctggcaggtgatattaggttttccaccacagtcattgaggggtaccccgaccaagattcaaatctacagctataacataatgagtatgaataatgtccgctgcaatgacaaactctaacttcaacaattgggcttgagtgagggaaaaagacagggtttctccgaaccggagtcatcctagtctgctttgtggggagggttcaagcaaacttttcttactatcttcagactccagagcgacaatcagtcccgcttttcatcttatccccgtgacgggccacaagaggttggagatgccgcattcggaggattcaaatgcaattgtggtgtcatgaatactacccccagtcatatatgagggtccttatcgcgaatacacgagggaggcaatgttttgcttgccttagcgtgcagaagttcttgacgctgaccgctcgctcgggagaccctgatataaaatagtcccaaggtcgcctgggccgtgtgccggtagcctggttctgctagctcatctgcttcgattcccgctcttgggcactttgatccacgttcatctgtcgtatcgtgatggtgtctttcggattccggagccgcagtgctcttcaggtgaagcatgagcgtacccccgaggaaaagtcgttgatccgccgtctggatattttcttcatgacatttgggtgcatttctcaaggtctgttgccactctggcttagctatgtcgtaacaacctaatccacggacctgaaattgacgaggcaccgcagttatcaaatatctggaccagaccaacatcaacaacgcctatgtctcgggtatgaaagaggatcttcaactctatggaaatgagctcaatttgtgagtaccgcgtggagaaaccaccatctaaattcccaggctaacggtgaaataatcaacatgcagcttctcaacttacttcaacatcgcgtactgcgtgatgctcattccctcacagatcatcctcacatatgtgcgaccaagcttctggcttcctggactggagattgcttggggcatcataactggactcatggcgattaccaagcacgcaaaccatgtctatgccctgcgcgtcttgctcggtctctttgagagcagtgcctggcccggaatggtcaccttactgagtaagttgatattccagccataaactagtgagtcgatgaaaaataactaactcatctggatgggtagtgtattggtatacacctaccgagttggctaagcgtataggattctaccattcgtgccaggccctgggctccatgatgtcaggcgccatgcaagccgctattaccgagacgatggatggtcgacacggaatcgcaggttggaggtggctgtttatcatcaatgcaatcatcaccatcatctggggtatcttaggcattttcatgatgcccgacgtccccaacaaacctaacccgctggcattctggtttaggaagggagatggcgagctggccatgctgcgcctcgctcgccatggccgtgccgagtccaagagagtcacctgggccggaatcaagcgcaccttttctggctgggtcgtgtactttatcgccatcttgtacgtcgccagcgtactgggaacctacggaaacgtctacttttcccttttcctcaagtcgctcaagaatgcagatgggacagcaaggtggactacctcccaggtcaatgccatccccattggcgcatatggtatcaatgtggtgtttgtgtggatttgggcactcctgtcagatttcatccgatcccggtggacgctcattatcgcacaggcttgcattggtatcatcacatgcattatcatgagcgtctggacctcccatcccgaatccactggtctggcagcggcttacgcctcgtatttcctcgctttcacttgcttgggtaccgcgccccttatcttctcgtggctctccgatctcatccctcaggatccggaagctcgaactcttaccgtcggtgtggctgttgcggcctactatgccatttcatcctggtcccaggttctgacctggccagcctcccaggccccgcattacaagtatggatggcagtcagccctggctttgctggtactcttgatcatcatgacatgtacgttacgtttcattgatgtcaagtacctgtcccccaagcgagaggaattccttcaacagttggaagccgaaagagaagccgacggtgcggacaaagcctctgtggcttctggcgagaaggagcccagagttgaagagacggcccaaaaaaattcttaagataaacccatcatgtaacttaaacgctcagggaattaatacccttgcgtagctatttcagagattgtatgaataaataactactcataaagagccctcgtacaagctgtcgcctgaaatcatccagtgactttaacttgcgcctcttgatgattttgccgtaagctttcctttcgacttcatagctttgttgaagataaaaggccgattgcggcggatcgttctctttattcctccttctcatgagatgcccgtagcctacgctttatgcctctctgtgcgcgtaactctcggttttccgcggcaagaaacaaatgttcacttttcggaacacttgataaccttatatcaactgtaacttgcttcatgaccgcccctccttactcatacaattgatagatagacttaacaaaaaggccactttaaagaaagcgccaacgcaataaactaatcacaatacctccgcttagatcatggtcaaggtgccagtcacgatcagatatgcaagttgctgaagattgttaaaaaagaacaccgacgtttcccgtgatttatcgggactctttacaatggcagcgtaaagagtttgtgctgatcgcacaaaagtcataaccccagaatcttctcacaatgtctaagggggggattttggcgtgctgaattgattaagtcaatacatgaaatcatgttcagttatgtgaagatctttctgctgtataaaacaagcacagtgtcctaaccaccatgaggaggacctcaggaaagcacaaagatagacctgctattaaaagaacagccctccccatctgtgatcataaagtgatgcatactacttgacatttacctaagtctttgtgcagaaaatgccctctaacaaagagagcatttacacagcagctcctctagctctgcacctactatgacacaattcaacctgtgaggtgagatgacatagttaccatgacgtagctcatcccatggtcagacggagtcatctttttcgtttcagaaatacgcgctggcctatcaccattcacaatgagagtgggggcgaattatttctcgccaaaacaatcatcataatccagctgacgccctcacgacttgactgatcaaagccaaaatcttcctttgattcaacagtatcaagctaattcagctagcagtctttacttcgctcaattccttccgtttcataatgtctagtgacaaagagccacaaacctcccggcgtgcttgcaacgacccagttgggaacgggccatacgccgcgccagtcaacggcaaaggctgcggctggtgtgacaatcaggacaagtatggctacggctccagtgtgtgtggacgctgcggtaggtgccatggctgtgggagtactaataacggcattgggcctgtccagtccatttactttggtggaaagtgggcacttggaaagctgctgagtaaaggaaatgaggaggataaggagaagggaaagggaaataaagagagcaactagctttggtggttgtgattttcaatgagttgagtgtgtcacaggttgaatggtggtttcctttttggctaactatttggtcagttggatttacgtatggggaacatattcaatgaaaaattagtatcattcgaatcgtattcagtgcttccgaaattatggttgtacttcaacacgggggttagacgaccatccacagcaacaggccttattcagtctgaccgaaataaccttgtcgttcacacgcacattccggtcgctatacatcagatatccacaaatatatcaggaaaagcatgaattatcacataagacaagtcgtattcatgcatctgttttcgcttctggtcatctatttccgtggtgtgttgcgtatttggttaaggccattaactacagacccatctctataccgcggttctgctttaaattcctttcaaagcatgtgcttgggctcgaaatcgccggacaaatggaataatgtgatcgggagtttatgctagaacatatgagccgttgtcatttagcttcgctacttaacattcagagcaggttgtcttgctcttgtgccctctgcagtccacatttctggatctgcacttactttctatagttctagataataagatcattattgaggaagaggaaacatgtcttaagtcgaacatgaagaatgataatgaatactaaggtttgggtcatatcgtataacagaatttcgtctcggaccaacggaggatatagttcaaagataatatcatacaaaatccgagcaagatcgtcacttcggattcgtattcctcaccctagtctttggtactttaacgagcagacagggacggttcatgggtctacgggacacgccgagcatgtaagcatcccctccttttcggcagactccaacgatccctagatgttccaccaaataaaatcgatcagtcacactgccaagcagagctagtggccatcgccgaggctcacaaaggggggagatcgatctaagacatgtgctaaaggcaacggcaacggtagagactacccgtgaagtgctaatatgggctagttcaggggtcgtgttggccgctcaggaacgtccgtgttcctgtcagcaaatcaacgatgaaaacatctgtcagatggcctatttagtggtgtggaagatgtctaaagggtgcttggcatatccagaaagggggcacacatccgaattggagctgagttatcaacccagatcagctcatcttggatattcatctgcgtaagccagatcctattcacgaggaaaattctacaaaaaccgaggcatagatgatgggatttcgaaagtgccgctagcggcgcttgtcattctgttcacacgacgaaagagcccttggcactggcacgacaccgacacttccgtcgtatcttgggggccatctatccccacggggctgcatcttggcgcggggtaacaccctggctgccatgagatgttgtgccattaggaatggggctcgtagtgaggtggttttgcggagcgggagcacgaaataatcaaaggaaattaacgagtggctctttgatcacaggaaagatataaatttgcacaaataccgcatggaaatccatggttgtgagccagctcaaccagccaggctgaggagaagcccagagtagacccagaatcctacctctaccccagctacagcctgagattcctgcccaccatgatcgtctcccaccttctacatctgtttgtccttgtagcagtccaggtgtctgccgtccctactgctgtccttgaagggcgggccaaagtcgccaccgcgaccatcagctccccctcggccacgcttctaggcaacgtcaacaatggtgttgagcagtttggcggggtcccctttgcagaggggaaccagagactgcagcggcccaagagattgacgtcgccgcttggcacagtcgacgctacgggccctgcaggggcatgcccccagatgattgcgactacggacgacaaggactttctccaaaaccttcttggcagcattgccaacctcccattcgtccaagaggccactggacagagtgaggactgcctctctattacggtggcccgccctgaggggacgaaggcgggtgataatctcccggtcctattctggatctttggcggaggctttcaggtgagtgaccagggtggtttcattcacatctctcgatccaaaacagagtagagtacgaggctaacacatctttgttaccagctgggatggtcttccatgtatgatggcgagggtctagtcaactacgccaagagcatcggcaaacccatcgtctttgtggcagtcaactaccgtgtcgccggctacggcttcctggcaggcaaggaggtcaaggccgccggcgtgggcaatctcggtctgctcgaccagcgcatgggtctcgagtgggtagctgacaatattgcggcatttggcggcgacccagaaaaggtcaccatctggggcgagtcggctggggccatctccgtctatgcccaaatggcgctgtacgatggagatcacacctacaagggcaagccactcttcaggggtgccataatgaactcgggcagcgttgtcccggtggaacccatcgacgggaagaaagggcaggccgtgtatgatcaggtggtcaaggccggaggatgctcaggcaaggcggacacgctcaactgcctgcgtggtctcagttataccgccttcctgaatgctgtgacttcggtgcctggcatcttgtcgtacaactctctcgctttgtcttaccttccacgaccagatggagacagtctcacggactcccctgacgcgctggtcgcggctggcaagtatgccgccgtacccatgattattggcgaccaggaggacgagggcacgctgtttgcgctcttccagtcgaacctcaccaccaacgaccgcctggtcaactacctcaagagctacttcttcgacagcgctaccacggcccagctaaacgaccttgtcaatgcgtacgggaatggcctaaccgccgtcatcgatggcagcccattcaacacggggctgctcaacgaaatcttcatcggcttcaagcgccgtgccgccatcatgggcgacctcgtgttcacgctcgcccgccgcgtcttcctcgcgacggccaacagcgtcaatcccaatgtgccatcctggtcctacctggcctcgtacgaccagggcacgccaatcctcggcaccctgcacgggtcggacctgattcaggtcttctttggaatcaaggacaactacgccgccaagggaatccgcgcatactacatcaacttcgtgtactcgctcgatcccaacgaggggagggggtcgtaccccgagtggccccgctggtcggagacgaacaagctcctccacttcttcgcaaacaagttcgagcagctggatgataatttccgcagcgccgggtataactggctggtgaagaacatcaactcgctgcggtactaatgggttatggggggaatgtcatctcatctgggtagggggaacgtgactgatgggttggggttctgagggggggctggggtaaacaaatctacgtagtaatgccgataattaccttgactcacgacccacgcaggcaggtcacctgcagcctggagtcccctggaccatgtcaatatgccgtagcggtgtgtgggagatggagatgggatttctggcggggttacacttctcgcgctgggctgagggactttcgcccgtctggtcgtagtcgatctgacatgataatcgcccaagcatccgccgtcccattgcatcccgttaccgaggtttttgggaatacgccagcatgtgaagcagatatcatctggtgtcccgtcgttttcgcttcgggccccctgtccacgagcccgcatctgatggcgtcatgagatgtggaggagccaataaggcagtcatcttcatcatccttcgggcgagactgtcgtttcaggtacgaactccgcggggtagatctctgtgtgggttgcgagatgcagccacagccccagagagactgtctgggcgataacaggagtgagacatcgaaatacgggtcttgagcagagcactttcttgaacatggagaatcagataccaagctggagcgaattcaattgacaatctcaaattctctgctggatgtttttcattagctgtcagtaacatgacaatcaacaatcatagagccgaaaatccagcaccacaatgattgggggtatcaatttcagagtcaccagttgccagcctgttcgtcagcttgagagtcatgagggtggtgtgggtgtcgccaaagcaagtgttcatgtatgcaaagttcacgcaattgcatgcctagaagcaacttcaattccgaatgcgagggggcaccacaggacgatgtaaacagtagcacaatcgtctgatggtcgcgcttatgaacccaagttcagtagcaaggtcggagttgtcccaggtcgatcgggttagacacccagatcacaagtgacggtcacagtgccatgaaccaagaatagaggagcaataactcagtctctccgcggctactcttcttaaactcgcctgaattactatctgactatttgtatcacaacgaacgaaatgaccgtcgctgacatatgtttaatgaagttttggacatacgttcgagagcatagagatcattctggatgagacatcgttcctggcttggtgaatattccggttggaccatcaaggcatggcattcactgcaagaattccaaccgtcagtgcgctcaagtaaactatgtcattctctttggtggtttgctttttcgcctttcactccacagtttcttattcgacaagatgcctaaacatgttctcactcaatagcaggtctttccttctaagttcaggatggatgaacatcggttacgcaggagttagtcaaatgcaacaaatctttccagtgatcggaccactacatttattttcacacccagtttacatgaacaagtatctagattgtgtgttgagactggcattcatcacattaccattagctcatcaatattcgttcactatgcaaagacaccttccaaacatgtaattatgttcaacccagcatctcgagcgaattcttcaactccgcccactgcacctaaaaagttctccccctcacggttacagagctgcaaaaaaacttgagcgttacggtgagtcccaccaaaacgagagactttggcactccggtaaagttcccatgtcctttcggtgcatcggtgccggtcgcgccgggggatgtcgggccgctggtcgaagacgtctcttctacaccggcagaggccgtctcggaagcgtttgtggcggagtttcgctgcccgttaccggctgtttgagttgatccggctgaagtagtcgttgcactggtcgctgtgggcgaagatggacaatgcatagaagagaacgccgagctttgaatcgatggccagtcatcagcgtcccctccgtcatcgtagaagtcagtggagtatgagtatggcttgtccgtaccgcctgtgacgacgaccatgacggagtgagactgcatgtagcaggtatccacgctctccgattttgtgggcagttcggcgctgaactcgtcagccttgaccgtcgtcatggcacattgctgctccgccaagttgcagtcccaggacgttctcgaccctgaaataacgtggtttccagcccatgatgatccggagatgtgtgtgatggtctgttctgggaaatcggtagaggcacaggacgaggcgcaagtcagcgcgtacacttgcgtggcggtagtcgcagttacgagagatcccttgaacgagctcgggaaagtggcgtggggcaggaacatttgccggtgaggcgtgtagggccgagttcgcgtggatgtatgtcgtgatggcattgttctcgcgcgctagtgatattttctgagagctttagctgtgaaggatatcgtcaagaggagcacaaacagaagagatgatattcttcatacatcatgccatttcctactttagtatgtgagcgtcagggctcttgggcgtcgcctagagctgcatgtcatttatttccatgctggttgattctgccttgccatcaaaggcctgtccatccagggtaaatacgaaggatctgccttgtatgccgcaaccaacatcttccgcgctgaccaaggaaaggactccctggcctgtattgagtaattttaatagagggaaaaccattcaggatcaaactatgttattctcttccattaatgttgttcactaatatgccagagttacatcgtccacgtggatatgataatggaaacagttcatcaaaaaggtctaattgtcctgcacaactgatcagcggtggctaacataattcaagaattgaccgccctttaacattgtgattttcttagaagaaagaaacaggttttccaattagctgatttagagatcaacaaaggcctcaagctcaaatacatgcgggggtcctgtgaagaaagagatgaatctagagtaagaaataacaccccctgcttctcgaatcaactgtttcttctgcaatgcgagatgtgagttagagtggtggtcgcgttgtgtgaagtgaggcagaggataattgcatcgaggtcccatcaatgcgggcttgatgctatcatgaagctacatgcaaacgctaccctcgatttcgacgcagataactgcttcacattaattatattcaccagcctgtgccgcgtgaagagagctggctgaaagccattctggattaatcgccatccaggctagagtgcatctcaggcacgcttgttttgaatctggccgaaagaacgcaagaaatgataagttacaagcaggcattgaacgcgagtgagaattttggtgccttagagttgaatcaagtcgaggtttgtttactttacttggtctccgcgtcactgtgcattgctcctcaggccaaagtgacgtgcaggagccactcacttcaccttcacccaccttcaacatctacctttcaacatctgcgtttcttcatgactccaacttcattcttcagcttgtttcctcatctcatccacttactccattcgcctttctagacgtccgaatcgagtgcaatttcccatgccttcccgatcacgcccttcccggtcctcgcgatcacgaaccagccggcgaagacatcagcgaaaacaccacgatctgaagaacaacgaccccgagcacatctggctatccgaccagtatcgccttgtgcgccgcttgcagtccaaattagaaaagcgcttcaagatggccaggtatactgaggcagaccttcttcctctgggatacaaactcggtgcgcccctcgatgtcgatgaccccaagcctctcgacctagattccagattttttgttccttctacccgtcgaccagttaggaaggcccttcgatgctatgcgaaggaacgctggacacctcgcgagcctctcaaaatcccacacagagcaacattccatgggtcgggtgcaaagggcaagtttaagagagagactttgggattctactcggatcgtggaaacgaggcaagtggaaacttgaactactttttacgggcagcaatgatgtacgagcccaggacctggcgttggactcaccattcgtatgttcctctttcccacctccaaaccgcctgccatgagaagccagccagctaattacaccatttccaggcgaccttgctggaagggggaaagatatatgcagaaagcttggctcaacagctctcacgaacccattcttcatgaatgtggatgggaaatgtggatgtactctgaagatgattacggcaatcctgtcccaaccattccacatgctcttggcgctatttacgacaatatcccagccaaggaacaacaggtccagaaggtcgaactctacctgcttctgatgctcattcgaagccaattgaagaatgcaagagcctggcctcggcatcgaatcatccctgtacgcccgtcatgttcccattgatcgttacaaacctcgctgaccaataaaaccacaggctcttgcaatcagcttccactcacgctttactgctcggatcgttcaggcccatctcgaaaacggccaggttgtgttacgcctttcacgacttttgaatttgcatactaccaagcgcccggtcgatgggaaaatcataataaaatggctaggatgtcggccgatgggtgacactagaatggggccgcctcctactattcatcatgacgatggagacgaggaatctgtcgacgacaaggccggtcctgcacaaagcatagctattgtaggttgaagggatgacaactcggttgtccgaagatgagtcttcgtgttctccatgttgttggctcgatttatgacgagatgggcgaatgcccaggatacattaagcacccccaataacgggctcaataaacaaaatcaaatgccgagatcccatatttctgcccagtcaagcgactacataaaatatggcacacctagaacgtccagcgttaaatttcaacacaatatcaacccactggtaaacacaatagcaggccagatatcgtagaataatctgttcctttctgaatattacgtttaataacaagataatttccctaccttgcatgaaaagagcttcagtatgctatgattttttcagccacttgccaggttgggcctttgaccagtatgaagaagaaatcacatcgcccagacttaggaggcttgtgatttgcggtgagaacttgctcactttgctctcacttctgcttgggaaaaggcacgtcactcgcactgcactgccagtacggagaacaagtaactcgagtttctaaggcgaccaaaaacaaacacccaacccgaagacccacattggactctccccttcacgcttctgcctctgttttccttctctcttttgcaacttacgcgtcatcaccttctccaaacatccatcttttaccttcctcctacttctcccaaaactcacatattccttcactcagttgtcttcgcctgctttcatggatctcttacattctctacgcctaccgacagaccttccgtcgttggcatgattccgccttcttgatcctgcgttccagctcatcgatcatgataatggctcctttcaagcaattacttaatcttcccgatcttcccaaaaacgagatgtcatgggctacatgtatcagagagcacggccgctcacttcctcaaagtaacccctccactgtgtccctcgataacctcgagcaccatctcaagtcggcttcaaagctcaagttcccagactggctgatcctaaaggccctagtcatcgaagtaaacgagaaaccaacccccattaatctccttggcgagaaagtcggggcctcgcttgaaaaggagaaccgtttgcatcttcaaggtgaaccttggtggccagctgttgagtccaagagcattgagcgtgcttcctggagggagatgtggttatggaagaaggctcagctcaaagttgacagacggacgattaatttactcagtaaactctcaccagatggtctagagatctcctctgacctggacaacactgctgagcccgccgaagattgcaggccgactgcccagcgaggccagaacaaaaggcgctcagaccatgcagccgacaagcgaactgcagtagatcatggcctgacttcaagttctgaaccgaaaagtccaagcgagggaggcagcacggcatacggaagctcttcagacgaggacatgcaagacgaagctccacccagcaacgcaattggccaaggcaataactccgatactggctcatctttcaaagctccaagctcgaaaagcagcacagatgatgaatcgataatgggcaacgatactcgcaccctgagcgatagcccaccagatgaagtcttggtctggtaacatagcgctgggcctcctgttggacggaatcaccgaatctcactccgatgttgatggcaagtttgaatggacagctttccacaggcgatttggagtttcccagctccaagaccgcgacaacgaggagaaacgcgagaaggtcatggcggcaaaagtagatggctgcctccagacaatcgaacctggcaaagctcgaagaacattccgacgctttgtgcatcctcgaaatgaagcctgtccgacgaaaggccaagaaacttcctattgcgatgcaggaggctgccgagatggcagcctggatttcaacggaacacgagcttgggctactgccaagcttccaatcggacgctgcgggcaacgctaaacggtacgtgtattcgatcctaactcacgatattaatgtcgctcgtgatattattcaccatgattcctgatattgttcagcatggtccctgatattgtttcggttgcagactaaccttttatatctgcaggaggttcctcatctcgcaggatctagacgaaatctgcataactgttgcagagtatgacgatgactatattcgttatatcccaaacacaacaccctcaggagcaatcgcggtcaaggcccaggccaacggtcagcggggccagaaaaggcagaggggccaacaggagacacgggagcagggagaagaggacgaggagagtggcccagagcgggagaataagcagaagctggaggaagagaatgaggtggaaagtccgcatgatgagcgcgacccctagagccgggttcatgacaatcagaacgatggcgatgatgagcattacgacgatgagcatcacgaggatagcgaggcgaccgatgagggaacgaacgaatacgcacaacacaatgacgagagtgacaatacccttgaggataatgggagcaacgggcttgaaagctctgaaaccactggcgagaccactgacaaagatcaaggagagaatgatgtccccgggtcttatgaccccaagaaacgtacgccgggtttcctcacaatgaggcaatttgagcctattcgcatcactgaggatactattggggacatcatggtcctgctattatctatcacagtatcgctttgccgcgagcacaagcgctccgttgagcaacactaaacattgagattgcgctgtttattgtacctactgtaggatacttgcttccatagtttcagccaagtactgttgatccaagtcaccgccactgttccgaaagaatgggaagacttcaggcaacagtagccccagatagagtaaatgaaaagtccagtccttgcttcacctcgctcgacaagctgaatgggtcatacaaatacagtgaagagggtgtgttcgctactaccaatgtggcctcctcgccgctagccagagtaactgacccagacccctgaacagccacgtaccgcgtccctgagctcttgtatacggcgagggtggcagcgtatgctcggttggccgtgatgctgactgaaatggtgcttcccgaggcacgcagagggatgatgctggcacccatgtagagcggctggcgagcgctcttcaccttgtacgtgccggttcccgtctggtctacattcttgaagttgattgagccgcgctggttgaagaagacttgctgggcctgcgggtggccaatgtctgcgtaggccatccgtgcccaataccttccaacaatggtggctatgctcgtactgccagcaacacgctgaagggtgtggaatggtgtttcgttactgttgggagagtaccggagcatcatttgccggagtgtgtcggtacccaggccgctgtaaccatctgggttgttggtgatgtaggtaaagaacggccaagcctgataatagttgccagtattgacagaaccatcaacgagaacctggaaggagtctccaaggaccttcccgagctcaatctccgttgttccagttggttgattgtacttgctcctcgaagcactacatagattggaggtcttgtaggtgtcggcaaaccagttggcaaaggtctcccaccaggcgccggtccgtccctggtcaacccatgtcttctggtgataatgcactccgtggccgaactcgtgaacgacaacaccggatacggtaatatagttctgctggacctcaagccatgccatgccggtgccagcgtcggaatgcatcacgccggctgcccctgggagggaagcgaccgagtatacgttcactttggtccatggcccagcattggacgcatcattgtaggacaagccggtggacctaaagcccaacgtcgtgacaaaacagtcgtatgcgccttcaagcatagcaatcgcttggtcggcagggctgccattgttgccgtagatgcggaagtgcgccgagtctttgtagacacttccgcctgggccaatgtttgcattcgctgtaaaggtcgccggctcagctgcgacagcaacatccggagtaggagccgcccaggtccttgaagcggcctgagagaggatgacaagtgtgactgaaagggagggaaacatagtgaaggataaccaggtcagctattcggtagggagaggtttcaacaagcagtgaaggctgagtgaaaatatcttgctagccccgttcccaagtctctcgtgaggacatttatatgtcttcatgtatgcatccaaggattgtcgataaccgttaaagacttcccgttaaagacttctggatcctgccaacacatgcgccagtcccatgataccaaatgagcatttagttgttcccatccgaataatcgctcgaatcagatctagccaagaccctagggaggcctgctctttccatactctgatacattggaggagtgccggagcatgctaccgcggatcacgttgacaatgcaccgctttcagaatagtcctagagccggtggtgagcccgattggcaccggcaggcgatcccgatcagtgggatcatcactggtggttatctaaatagtctataactctctattgatagcgtgatttgattgaaacgctcttaacgatgtaacttcggacattttatacgctctcgtccaaaaatccccctttgttgctttgcttactgacctaccctataccaagcaccctcactggacccgaccatctcaatcactttcaggcgcgataatccgcaacatttgagacatttatgctttcccataccatctttccaagacttggtattcagatgagataagatttcgtgctagtgtgctttgatacgtggaaaccaaatcatctaggccggggtgtgtatcgggatgtggtggtgacaacaactgacatctcaaaaaggaggatcggagaatgctactgataaagtctgtccgggaatggaaggtcactaactctctaacaggcgagcgaatcactactacgctgcattgagcaggttcaagagcatgacggagggctgcccggtaatgatctaatgcctatgggagcttgagatcacattccactggttgtggattgaaaccggctcgagagtatgcttagattgcatcagcaatcgccagggtggcataatctaatgtgttgtttgcacaagtgttcacccctgagtgagtaccgcaatgcagcttagtactgccactgtgcagttccgtctaaattatattgggtatcatagtataaataacaggttacactgtccattaaattgcgtttgtcatttcaccatcctccctgcaagtggtctaatcaagcagccaatccaagaacctcgctcaagaacttgggctaactgatttccgctgaacccccgtgatctaatcatgaatttcttggtctcgactgagtcatgccacatcccctggcttggcttggctgtcgctcctttcctcgccagtcgacggggcagggagtgatcccatcgtggtcgcggagtcgcgatcccggacgctgttgacaggaagcaatccccagtgccctagctctttaccctgattgtcttaacagtgagaaatctagcccagttgagactctggagctggtatggaattacgggccaaaagcgtttgggcgtgaaagtatgatctgccaccagtgtttatgcaaataccctctgttaatgcatttgcatgatccagccaaagcgatcttttgctttggttaaagcgatcatcaatcgcagggtgcgcgcgtttgaccacacaagacaggtactggcgggagtagagcaggcatctccgcgacatcatggaatgttaaatgcggattatgatatatcaacgcacatatttcgtgtcgaaagggatgtccaaatcctggatgcaatcatcgctcggtgaatgtgtagccgattggcattgctgaagattgctggtgactgggactgtaattgcaagcctcacgtcgtggaggagagtaacgtgatatgatctcggtgaaggtcttctagcttggcagtcaagtcgccccctcaggcaaatcagccagagcaaaatggctgaaggaaagggaatgccttcccaaccttctccccccaccgccaattgctgggattttgaaggtgcgcctcgaagactggatgcagcagcatggtctgcttgtcgggagactcgataaaggcggttgagtcttcgtacggccaactcacagtcagcgaagccccagacagctccctcaactcctcaaaccggccccagtccatgtctttgatgatagcatttcgagcttcaggccacacaatgacgtctatccatgctggatggggtaccttgagctgcagctcagtcggtcgaagcatcacgggcatcttctcgtatgtctccttggagcgacagaccagccagcgaatcaggtgtgagagggtatacatgaatccaatccgctcagcgagggtcttgacggttgaacggaaaacttgagctgcaacagcattggagaacgaccgagcccagtcgcgttccaggtcatcggggcggttcagcagggagctgatactaggaaagacggatgcactgaactcggcctgcttgccggacttctggtagcgagagttccacgcttcggtgatattcttgatcacttcatcgagtttcgtcgtgggagccagatggggaggcactctttgccagtcgggaacgaaactgggcgtcagggatttctcgtctgccgccagacttgcactcgtcgggctgtgggatatggtcgtactgtcgcttagcttcctggagttgaactctccaaagccatcaccgagacccaagtctagaagcctgatgtcctgactggggctgattgtgttgatcgtaattcccgtgccgaactcaagaggtaggctgtaaagagccctatggccgatgggagctgctcgcgctgtgtgcatgcctgcagagggctcgctgtgctcgagatccaaggacggtggcggcgagagcgtcgttgaccagtacggcccctgtacccccttgccattgctcgccttctcactttcgtaatggtcgatgagttgctcagcctcgcggagtcggccagtgagctctagtatcttgccctctagggagcggatgtaggccttgttctttgcccggtggtgccgctggttgtcgcggtcaatggcgcgcttcttctcggcctgctcggctgtcaggttcgagatgcggcgggcggcgttgacgctgctcatggccgagctgctgtccgacgatcgcctctccatttgcgaagcggacgggcaatgcgtgtcaattaaatgggttcgtccgcgctgagtgtcctctgagctcctgagagccgtcaagaggtcaggcaaaggatgtcaaacgtgtcatgttagcaagcgatgtgggcggctccctcgactctgtgtatttaaggatgggcggtgcgatctctccactttttgggcaatgatggcatgcttgtgcgtgcgaatgacaccatcgccaatctgatgctgtgtcatgttagtggtcccacccggcgagcaggctgtgtctgatggctgaacgcgatgggaagccaggtgaatgctgctcctgcgagccggtcattagtctggtattgtgatccgaggagtctggtgtcaaggcagaaggcttcatgacgaagaggcgaaaggggttgaccgtcctggactgctcatcaccaatatcagaatggccgtgtctcaccggctctcgccatttgactcagactaccccgcccttgtcagaagcacatcattagtgagccaattgacacaagttgcccaatctccaagtggcagttgagagctgaggcttgctttgcgcgatgtctgcttttctgctttctcggccggctatgtatttgttcaattggccaccgcaaccaaaaagctaattcttctttgccttggattagactttgggatctccgactttcatgaagcaagcttcactggccgcagtagtaatcgcgggtgcacgacgtgaggtgagattgcaccattttcataatgctcacgcaaggggcgcaagctcgagctggcaactgtcaggagaaagaaggttgctaccttcaaccagaccggcaccgacagagttttgtagttggagtttggacgagcaagacgaggtagaagaaaacatcataatgatattgccccattcattttcaccttgctggacactccactcccctgtgcttatttttccggtaggcttgctgctggaagctaatcagccattaaaatgactgtcccaatcccacaaatccttgcatgacaagtgttgttcgcagttgttcatgtaatctttgcacctgtctaagcgtgacaccatacactcgcatagatccccatgttttcagcgccgtatgacaacacgattcaggccgaagctgtggggatatagatcaggcaacgggtcgatcgggttctttctgcatcgggattgaggagatcaggcgagatgggttaaagatgccacatgttgcatcgtgcattaaaccatcgagacccaattttgagtggattatgcttctcagctctcccttctcagggccgggcctgcatggccaacagttgaccgaccaaagctcacgataggggaaggttgcagcctgcaggttttgaaaactaccggctgccagggtcgcccaatggcgctgttttaattagaaatcagcggcgaaatccgtgacatgcatggatgctgtccccaaataagcaggtgctgtagcacaattgccgggagtttcggtaatggacctgtcagcgatcaacctagaatatttgacccaacatgcgcgtcttcagaccgaacagagagaacggccagtctgccaggtgtctaatggatggtgaataacttatgctcgacatgcgtatattaatgttgtaaataatgcggcaaaaattactggcaatttcgatctatgtgcgtattcagtgtctacccctgtccggttcctgagcacggtgcacgttgccacaatctctgaaatgcaagcacttcgctaattacgtctcttccgttcctgaaatggattgccgttcctgaacaagctagttgaccaagatcttgccaggaacatctcggcactgacagcatttgacaggtggtggccgtgcgtgatgaagcggacatcctggctcttgtgaaagctgcaaaactccctgctgagaagactgtagcatgtatgagaccgttttgcctgtttgccaccatatgccgtggatttcaggtcaactagcgttcaaaacgggcttaccgagtatcagatatgtttgcgaacgggccctgggcacatggggcaaggattcttaattttaccttttaccaagaaaagaaccaacgcgcgaaggaattctgagtcagattttagctgtcttatgcttattttgccttgggatatatagatcttggatagccattgactatcgtgaaagctattctccccattgcaccaggaactaacaatcccaaccacgaaaccgctacatcagccatggtcctctctagcactcttctgctctgcgcagctgcgccagctgtgatggctttgtccgtcggcaaacgccaagccggaggggcctactcactgccgagctcgagcgtcaactcaaccgcgcgagcagcggctctcagcgttaagcgggctggttgggagtatggcccgttcttggatacagctgcgccgttttaccccaagggagagttgggtgatgctgtcactttccaagtgaggcatgagtaagtttgaaaaaaatattggaaacagctaccagatggccagggactgacgtgtgtaactagctggaatacgactcagcaggaccctcaaagtgcaaagtcgtcggctgatgcccaggccaatatggtttccattgtctcggtaagtcgtgcaccgtttctaccgtccaagctaggcgtttactcatcaaacatagacgggcggtctcacgacactggaagattacaataagctgtacgacaattcatggaccaactccgcacccaacggaccttggaagggcatgttgcaaaattacacgagcgacttgctcttcggcatggagcgcctctccaccagcccttacagcgtcaagagactgcagcctaccgacagcctgcccttcacagttgataatgctgcaagcatcagtggacagtctctggaggccttgctggcaggcaatcgcctattcttcgtggactactctagcttcaaggacctgcctttgtctgcgggcaaatacgcagccgcttgccaggcctacttctacatccaccctcagagtggcgattttctccctctagcaatcaagactaacgtgggctccgatttgacctacacgcccgaggacagcgagaacgactggcttctggcaaagatgctcttcaacattaacgatggtttcaaccaggagttcgaacatttcgcagcatcccactgggtggccgagattgcttacttggccgctatccgaactcttagcgaggaacaccctatcatgcccattgtgcacaggcgtaagtatctgcatggatcccacttaacagaaagactttgtccgctaacccccaaaagtgatgaagctggcttgggcgatgcgtcctgctgccgccgagagactccttttcgtcggtggccccgttgaacgattgtatccttggaccggtggtttggcccttaaatacgctactgatctctacctgtctggtgtctccggttctttcactggaggctacttcgaaactgatcttgaaaagcgtggcctgctcggcaaagacggcttccccaagtttaagaccttcccttactatgaagacgcctccgttatcgtatcgagcatccagggattcatgagcaccctcgttgattcgtactactccaacgacaaggcaattcaacaggacattgagcttcaagcatggatctcggaggctacggaggctgagattatcgacttccctgcctcgccgctcggcaccaagaaggatctcgtcaagcttttgactcacatcgcctaccttgtctctgtcaagcacggcgtctcaaacaccaacagcgttgtcgctaccttgtccctgccattccacccattcgccctgtgggcccctctccccacggagaagggagtggccaacgtggtgcccttcctcccaggcgtggaggcatcagtcggacagctcttgctcgaggtttcattcaaccgacctacctgggtcaactcggatgagaacatcatccacatgtttgccgactctgacgtcctgagcaagatggacaccaaggtacagggcgctgccaccaagtttgccagcgagatgactgctttcagcggaaaggtttcctcgcgcaccttcgacaaggatgggctctcccagggaatgccttttgtctggcaggctctggatcctaaccaggccgggtactggcttgctgtttagactttccttgctttggcccttaaaagtgtaataatatttgctggcagttagactttttcagttcaagtcatagagtagacaactagtttcttagaataatttccttcttgaaatctctggattggcaaattgatgccttctatctcaatttcgtagtggagaggtctcattggctatcaaagtgcaagaatcggttgaaagaagtgacgaacacgaagaatttcacatgaaatacgtaatgaggcaagtacaaagcctggcataacatgactacattttctctaccgaaagctttcagtcgttcgatccagtattagcttcattgatgaccgctacatctttcatccaacgagtgataggattataaaattggctaaatgcggatattctaccccatttcacttgatttcattttgcggcaacagatggtaggcaggataaattcattcaagcatttatactttcaaaactggggtgcatatcatttcacaataccgactgggttggttcattgcaatggaggtctatttgtctaacgaaatcaagctttcataggtacttgaacaggtgccaagatggggttggatcagccccatggcataacgtgggaagtccatctttgatgagtcccatctcaaactgacgctcattgatcataatgtgcccctaccagtgaatgtcagatagctcaaaggctaaccacaaccttctgtgcagaaacgcctttgaagagatggtcgatagccccttgaatactctcgagacccttgccaaaaacaaacggcgttggagcgggaacataagcaccactcttgagtgcctgcggcaggaactcttcaaaaacagccttggcgctgggcgtgctgttcaaagcaggggcatatatcttcttggcatacacaccctcgggtggattaagttcacctgggaacacggtggcaactctcttcgcaccctgtgacttatctgcgagctcaaagcagtgctggtaggcgtcttttcctacggcatcaagcacaccgccgacttcccgacctgcgagggcaccgagaatgtcggcaatgactgtgggactcttgtagtcaaagacatgggcggctccaagctttttgacaagatcatagttgcctggagatgcagtggcaatgacctcgtagccagcatggcgcagaagctggatcgcattgcaccccacgctactggctcctccccagaccaaaacaactttgccggtagaatcttgggctggaaacgtgggtagttgaaggcctagccactcaggaagaaagagggccgaagaggcggttgaaatgcagagagggaggacaacagcagtttcgaaggacatgtcatccgggatctcggtggtggtgtctacactcacgacggtgtaagcctggaagccagcttcctccgacctcccagtagaaaaagccgatgccgtggcaagtacccggtcacccttcttgaaacgagtcacactgggcccgacttcaaccacctcacctgcgatgtcttctccgaggatggctgggtagggaatgggatagactgcgagtttctggagcttggcgtcgattggattcattgccagggcacggttcttgatgaggacttggttttccccaggggcacccaaggtcgattccttgacattgaaagggtaagccttcgcggcgtcaagccaagctgctgtgttggtagccattctgagagtgatgaaacttgtttttggcttggtgctgttgaggacttggaggtaagaaaaggcttgtgatagttcgattctgccttcaaccaaggggatcaagtccagaatttatactcttggaacgtccagaacgacttcgtgtaagttttgaagcacacatatgagctcaaaggaagtggagtcaccgcggtacactaacccaaagggatgtgatagcgtctgatctgtgtggcattacagaatttacagggaccattgaccgtttctgttagagggttgacaaacggggtattcgatttccgagctggttttaaccccgtgaatagagataactgcgccattctggcttgcaagccggacttcgggatttccagaacaagttagccttgagcgcttgaatattgcgagttcgatgtcacggaggcctcataccacaaagccgcagttggatttgcgcatgtacacgtatcaattacacatctccccatgaattgttaggtttattggaatctacagacgcgaatccagtatgattttcctctattcaatgaatcccgaccaaatgattatacaggcgcacgtcaaatgatgtctatcgatgttgtcaacctaccagcaggagtcagcaaggagcacatcaagactgaacgtaagtacctaccgttgcaagcactgtcgccatcccgatgcccatatcagacccgatccaccgtaggcaccttcggaagtagctacggattgccttgggaagatagctcgtctggcacgccgtgtacataggagacataagtagaaacccgccaagaaaccgcccgggatgttttatatctgaagcggtatctttctccatcaaacttgtctggtggttgtccgcaagatgaaataggacggagccagccatgtcttcagctatctgagtcccccgagtgatgtattgctgtacgcactgttttccgtctcctaagttggatgagaggtctataatcatagaaatgagtaacagcctcgcccctcgaaaggtgttccaaaccccagatacgtagagatcgaaataggaatccacctttcccggccacctccctactgcaggctcgtcagaatttgcagcagggggaatatgtccagccgtggaaggtcggaactcaggacttcgcgaagactcccaatccttgaagcggtcttctaactcaattgcttcctctacaagcaatctcagttggtctagagactggcaggcattgaccctctcagataggatgtggaagtcgactaataagctgtcaaacgcacccccagtattcagagctgggggcgagaaaacaccaagaaactgaatggttagctcaagcacacgaacggggagaacaaggtgtgttcagagagaagcctttgacgacaggtacaaacatggaggcctactttgttatctggattaaacgttaaggaaccggctgactttccgaggctcaccaaggccaaaagtccgtcagcatgggcgtctattgatgaataattcgtctcgtctgccattatcatctagagtctatagttagacttctatttccagggtatgcagtgtgccagatgcaagggatatggaatacctgatacagcccaagtagcatgacgactcgtttgagttcggctgcattattggcgttggagtatgcaattatcttggctaaagacgtgagaatttcctggtgtgccctttcgccctgggaaataaaggctggcctgtttagtcccttcccacggctagcaaaggaaactgctcgacaagccttgacaaggtcagaattaaatccaacctgacggaacagggcgtccaaatcagggaggtagctacgggagaggttctgattcgttgacaccatgccgtaatcgaacaggaaacaccggaatccaagcatctggctctcagcttgggatgtctccaaggggattagatcatccgggagtatgttggtgccaggcaggggaacccgtttgggtaatgaacactgtcgggcccaggacatgattgtgggttgtggagttgggccctgcgcctcatactgtcgatatatcatcttgtccccgtgctcatacccaccgcaagggcggttcgccttgatacaccgcatgcatgactggaaaacaaggttagcgttgcgcggatctagaaccccggaatgcttcatgatagattctcagcctctagcgacacggaacctccggaataaattgatacataccgggcgtccttcatcacactgaagtcaagaatcccaagcattagcacttctacagtcaaacagttggaacacaagataggttcgtgtaatagatgatacaaacctttttccgccgcaccctgcacgagttgcatcctttggaagggccgtggtacaccattggaatgcagaatctcgtggttatcaatcttgctgatgtgggctgttttggaggccgctatgtgacacgaagggttctgccgccaagagccagggcgaccgtatcttgtggcaatgcaagtcgagaaacccacgaacctctgtgtggaaaacagtacagatgagatgggctgatgatgtaggggcggagtgtcaacgggatgagtggaaatgccatcgggacgaagaggctggatctccgaagatgctcccgagtggcatcagacttgatcggatacggttagccttgcgcgtccagccccgtcttatgacaggggtttggatctggcggttctcggctgtatgagaaagaagctgaaatggatacatgtattgcgtaatgcaacgaaggcaacagacattaaagaagtctaggctctcacgaaactaaattatcctaaactcggcccggtgtgcctcataactctacttcggcgtcaaattattcaattcacatctcaggcacaagggtcagggtgtgaatactacatcagttttatgttctaagaaaatcgccccttgtatttgagactcttcttctatggcacatgtaaataaatctactccaatgggttgagaatgtcaagatacatcccacaaatggcgtcgcgagagagagaatggcgaaacccattctatacatcccgtgcaattctcgttcctgcacatttctttgattaggttgtaggtcataacctatcatgcaatttagaaaattaattctttattggaaatcagtttaagtattattgcaaataccgtcatattcccttgaagttcatgttgtggactggtgctgctcgccacttacatctctccccagaagtactattgataatcccatcatgctatttggacaataagtttctcgcattttatacaagaaaaataccttttagtttgcgtaaaactttgtcaaatatatatatatgtgtgtgtgtatgtgtttctctgactatgaattttgtgaatatgctggcaaccttgcttttcttcgagactaacatgagagaaactatcgaaagatgaggagcaaaggaaaacaatgtaaacttagaaattcgaattgacaagagaactagatgaaggataagacagagcatgttcactgtattttcaacattcagagtgcatatctaatgtagcattgagacctgatcaaacgaagttgttcctttgcctagatagtctaatctaaatgtttcaacttttaacgttctaggtatctgttgtataaaatcagcgcagaaatggctatgcaccaactaggatcatgtgagataataatatagctacaagttgactaatattgttatctacctgtaaacaagatttcaatgcaagtcctcaggcttcacaattacccagtttttatctgccgtgactgccaatccctcctttctctgggcctctgaatgctcttgtatcatctcgtttagttcctccatcgcactttctttgcggttcacccacaagtggatgccccctcgggcgacatcgacgccgtgaaatagcatcggcccatcgctatccggggtatcacctccgacaagaatgggcttcttccattcatcaatatacgtgaggatggcagcccacttgcccgccttccaggtcgctggcgtccacaggaatggagtcatcaccgagtccagattcaaactttcatcatagtcgccttctgtaatctgcttgcgggcagtggaaaggcctcccgtggcattcttcataagcaaagtcaccccgataacgttttcaggcttgacattgtagccatactttgggtctgatgccaccatacggacaagctcttcagaggcagcgctgactacgtagacctcgatcccgttcgccatcagcttattgtacagctccacctgaccggcgaagacttttggcggcgaaatttgcgtggatatcacttcatcaccgtcatagtattttgcggggacagtgctgttgagcgacatgagctcatcaacgtagcctttgagattccgcagcgagataccgctgaagatttgcgcgacccagggatagcagaccgcgtcatcaagttcgcagaggcggttatagtagctgtacagcgactcagtgtagttgctgctgtccttgaacgggatcagcttcagggatgggtccatggtgtctcgagtgaggatgcctttgttttcgaggaacggcagaagcgactcttccaaatcgaactgatagcttgtgttgtccatgtcgaatgcggcgtaacgtcctgcatgagcgttcttagcaatcatctcgttgagcgaccgggctgcatccgtgggccaatgtttgagttcagggcccgcgacatcgttcttgggtgcagcaagggccgaaggggccaagagcgacagagccgccgcgaaggcatcagcgtggattctcattctgaagcgatgggctttcccttagatcacggaaggtcggaagacaatcttcagagagttccaagtggcggtgcgcaaccttaagatcccaatttgaaaacagggctgcgaatcaatgatgagcgaaaacctgggggctggtgagacttttagcaggtttcagaactttgcccttcccacaacgatcttggcttttggtgagacacccatgtactttgagcaaaaaggcgcatccgtgtggtataaactacgttgataaaggtgcagataaacggataaaaaacaaactgtcatgtaatatgatgtaatgaatgtcatcaggttcgtttaacacacgatcactttcctatttcagctaaccgaaattgaattcttcaacgacccttgccctgggtaatggaatgtggacactgcgtacgtaccttactgaataccaggctaaaataactcaggcattggttcgtctcagggctctgaataagaaagaattgattagtaagttatagtatgtgttaccaagttttagttgcacggctcgggacaacaccctccccagccttggggactatcaattgagaagtatatttagcatcacaaaccctggttggcattaatggatggattattagctttgactagaccactgagatgcagattactatgcataccacgaaatgaaacgtcttccgtctgagcaatgtgggttccaaaaaagtcctcgaacctattcgtcacgcctggcatatcggacttgggagtggtagctggtttcttgaggaggcattgcacagctgaggtgtatgacagtctctgtgacgtttagagtgcgccttgataccgacaatcagcttggaactcttgattctgcaaacagaaaaaactgctttgtactcaccattcctttcggactgtaggttccgagcatttcgggattgcttgcgtgtgcagtggtaagaccagcgatactaatataagaaactttagacagaacgccattggaggcgagaagaaacgaatgaagttgttcatggcgtaaagtgaaacgcttggaaggataatgagttagggaaagaccaattatggtagacagcacctgttatttatacgagatgatttgtacctgacctctggacacatcttctttctttcgcatggcttgttgatttgattacgttaagaatacaggtgaaaaccctcagattcttgtaattatgtcactgccactttcttcgtattttgacagagactttgaagacaataactggtgctagctgtctacttagttggactcgagttgaaaatacctgatcgactatggataaaactgggtggaaatctcccatgtaagacccgagacggccaccgggagtttcctaagacccgaaacgccgcccagatgtggactccacacccgaatcggcggttaagagtcttgatacgagggttgagttactcctttgctgagtgatgatatgcaatggattctggtagacatggtttggcttattggctccaggagacgtgtattagcattctggaccatgtatcattcaccactaagcatgccccacgcatagccccttatattagcgagtatcggaactcagtatctgaaagtttgtagatggggtagggaagattctggctagttgctgtgtgtcattgaggatgccacctttgatggaacttgtagatggtagcatggtttaccacccaataattgaggacattcacatccaagaaaaacacatataagccaccaccatcaccataccagcatcatcatctcctcctcctcctcatcccccttcttattctagattttgtcttcctcacacgggtcttcagtcctcaagactaccgatattgtgatccttcaagcattgacaattcacttgggatggaacagtaacgctgcagtcgattatttcacttcagaggctaatgtatgcgacagttatcgcttcaaggaggacacggcacgcatgcgacctgggtgttaagcggtgtgtgcatccgcatcgcccagaaaatggcacttcgcagggacggacaggcgctgggtcttcctcctttcgacacagagaagaggagacgtgtatggtggaacattgtacttctcgactttcgatccactatatcatctggcttcacgccttcgtcgctgcctgcgactgcaagatgctgaccaatatgaacgacactgacttctaccccaatgcgactgaaatttttcaggaccgagatagcccaaccgacatgattgtatttctattactttgcgggatgattcatcatctatttacgcagcccggtctagaggatatcataacctccatggaggaaaatgccgtttccagcagaacagggagtcaaggccggagtgccaagctcgacaagttagcagcaggtgtagagggccatcttgacaggcttatgcagcaatactctgaccctattgcaggacctctgcatcaagacgcatggcagatcaaatccgctatgaccaccaaggtccgtaagatgtgccagcagtcctggaagcagcttgaaacaggttcacaccccactattcggaatgatcatttatttcgcctttccattgacgcgattgagcacgtcactactttgtatcagagcatggcaaccaagaactttctgtgttcgtttctaccctctttgagagtgagctctttacatacctagttggagagcttcacagccgcacctcgggcgtattggtggagcgatcctgggcgctcataccggtcatataccattaccaccatgagctgtttgatttgtcaattgagttgaatgtcgttttggcttcgtttgttttgaaggtctggagcaagaggaaaggaatactcgaaggcaaattcgggcacggggtggaagcgctagcctatgtgcaaagactggagaaatcgaggctcttagacggcatcagtattggccccttatctggcatgtcgttcccaccgcccccaatggccctgggctttttgggtccccaagacatgccgtgggacccccggtctatggggttcatgaaggaaggcaattttggcgactctctctggatggaattggaattggaatcagacatgcagcgccatgtcctcggttctggggaagaaaccgacaataccctcccaaaagactgcttggcggatccccaggcaccctggtgacagagtgctcgactaaatgccactactaagtagcagtagcttacccttatcccccttctttatgtcaaaaatcagaatagagtgagtctagagtcgtcgacagatctatcatagtaacgatataaaaaacgtcacgactaccaagggtagtatagatgactactaatactcgcggagcttgtctttcctatctataggaattgtccaagctttttgagtagggtgtagccagttcattcataaaggtcatagacacctgacttattaagttcctatccgacgatttccagtctatactcttagacttagcgttgcaccactatgtggaaatatatcatcgtattcaaatcaaaggttactgtcatctaatcatgccaggtgaaaggcctcaagctttatttgttgcgtccttcacaaactgccgggaaagtttcaagcgcgggccttccaaccatgactctgcattccttttgaccaagcaatactccatttccgcctcaagaggtccatttgaggatagtgtctgactgataattggctgttccacatcaccaacattatcatcttgaacactctcgttctcgtcatcctcgtcatcctcttcattctctttgccatcatcgtcgtgctggtctgtctcgtcttcaagatcatcccactcgtcttcagcaaactcataactcgtagcattctcaaaaggctcaaaaattggttcatcacccggcttcggcttccacaattgttgtcccgtcatgccgggaactttccacaactcttccgccgaaagagctatcatggcggcttggttgtagtccgtacggatgatatcatccttagattcgagatgcgtaagagcccacctgaagtcctccttttttccgctcttctcccagatgaggctgagctgagatcgcaacgcttcatccacggcattcgagaaagccatttgattttttaccctgtctcggttgaaaggcgaatcctgcaggtcatatgggaagccttcctggtatataaagccatgcatgaggaagagcatcatgcgagccgccagaaagtgaccattaggagcgccagcggacaacgcctcagtggtcttcagcaaggccttccacccttcaaggagggccttgtctgcctcgatgatcgcattccgggggggatctttgttccgtttgtactgctgcagtgtacaaatggccagatagagacgttgcaggaggccggttaattgactgttggtggctgctgcgtctttgttgcttctgattttttcaatccctatgagtatgtcttccgcctccgaaaccgccgcatcgattactgctttctcccttttcgaagccatgctctttcaattttcctttgtggaacagcagctagtcggtgtagaatcaagtctttgtcccctttattctgcctctttgaatgcaactatccaaatttctaatcttaaagctaattttgcaatccactatgccaagcctccgcttcatgcatatgtccagtggcaccattaaggaaatatgcggtattatcgagttaacaacattgaatcttgtcagccaaatgagatacggtatttctcacagcttctacgagcaacgggcaggccatagaatgatcaaaatcggtgtcgtaaactgcatacaatctgtagtttccagacaataaaccatcgacttaggatcctgcccccagtcaactcaatcccgctagtcaagtagacctgaaactatttccccacagagccctcggaaaccaacccataatgttcgaaaagctcagcatcgctcccctcaaaagcctctagcttttcaccagccatgattaactccctgcacttctcagtcctggggcgaatgcggaacggaaattcagccgggcgggagataacgcctgggagaatattgagcgacggttcaacctcatgcccttctgaatcgacttccttgctgatttgaaacgcagctaggctccgtgcaatggcaaggtaaagaaaagaatcggcaaagttcctgccagggcaaatcctgcgcccaaaaccaaaaacgaaatcttttgggtcgggctcattgtacggggcgtcatacctctccggcttgaaaacttcaggttcgtgataaacactggaatcccgggcaaacaaatgaaggttagtctgtataatagctccccttgggatcaggtatcccatgtataccaaatcttcatcgcttcggtgcggcaggcttagtggaacgactggctgccaccgatacatctctttgacaatatcctccacgtaaggcaaattagggcggtcatcaaagttcggaagcctgtcggatccaactactttttcaatttcttcatgtgccttttgaagtacctccggatagaggatcatagcaaggtaaaagaagctcagagtcgagaccgtggtatctgaaccacctccatataatgctgcagccgagaacttgagtgcagattgatacgcagaatcatccaggtctttggcgtgttctaatgcgcttgaaacgtacgacttcctgtgccgattgcctgccatctgccgtcgtacgaaatggaacggcttctcggctgctgctagaacctccgctttccaatcgcgagctgctcgcttgaacccggtcccgggaaatcagtcaggcaggtatttcagagcaggcacgacatcaactagccaggtcccaggtgatgctgccttattgaagatggccatcatgcgagtaacaaggtccagaactgggtcgcgacgagtcgtgtcgatagaatatccgtacgtcaccttaatgatcgatgagccagttgcactagaaagactatcagtaaaacttctgcgtttcctgaatagagaaagatagggaccagacttacagctctaggtgatcaagcaacttgctgggttcattcaatatcagtcgaagcattcgtaggacttcaaatcgttgggcctctcggaatccctcaactatggtctttgtacccatatgttggtgcataagcttccgatgaagacgaaaggtttcattgtatgcgagtgcacccgtataatcttcgaaaccgcatctagtaatgaggcttgagtgaataatcaaagcacaatgaatgtagtatgtcttacaatccgaacccgaactcaagccaaggtctagaagacgttttgagagacttcttatccaatatgtcgacagcaatctgtttgtcattgagggtgacaatagattgccccaagacagtcacagaagtgaccggaccatacttctcttggtgcttcgaccaatgcttatattctgggatttcctcggtcggcagatcatagatgttcccaagcagaggtagtgggcgaggcccaggaggaagaggaactgctggcctcttgcgcctccgctgttggaaaacgagcaacgatcccaaggtgacggcaattccaaccgaaaaaagattacttgtagcttccatggtggtaatttggttttatcagttagaggagagcaagctcaaagctatacgtatatggatatatcttctagcaccactatctcgtggtactcgactgcgtgagaatcactgtggtgagactactgagaagaaagcgtccgactattatgcatcggtgccaggccagatacaaccgacgcaagagcatctaggctgggagaccaaaggtcttacaattgccgattcaggctagaatggtgtcttactgcattgtgataccgcatgccagcgtgcaaatactacccaatctagtgattgtggtgggtatctagctgtgtgatgcaggtttgttcgctcttaatttccaatgctacggcagccgagatgaggatcttagctgaagaacatattagtttgtcaccacatattatttcccgtcccggagaaatagctgcttacgatcactgtgtggctgattggctttgtaaagatatcgtcataatgctccttataggcttctcagtgaagatggtggggggtgctgcaatgttacaggtaaagctatctttgacgtgacagtatgaccaccctccttggcgggatttgacttctcttttgcatgatagtcattaaatgtgacccccttcatgagctgtcacacaacaattttcttctgttatcatgtcttggcttactcctcgcactcggtggttacaatacccaaataatccaatcggctgtgcgtctacgcaacgtcagcggttatttgcatccccgaaaattgatgaggcgggaaggagaataccctcagatcaaaagtcttccctgctggatcgtacccgaatgggtcactccaagcaaggatcagcccggcaattgcctcgtgaccatcgggaacggtgaggaatctccagccatcgccgacgtcgctctgagacttccataggaactctcgccctcggttcgtacgtagcttttcctccaggattagtacttgcgtcttaactgcgacaactgtccaatagggggggacttgccttgaaagcatcaagatataagcccattcgaccagcgagctcaatgatacgctctccacccggtccatcaatttcaaaagtttcaatcatgtcgtcagggatcggcgttccattcacctctgcagatctggcaaacaccggatcaagcccactggcatcgtcaaagtccgcgcgcatattgcctacagcctttgtgatctccgtcttcttgatcaaaccaccagtctgcctcgtaccagtctgcacgctgtaaacggtaatcttcttcaaagcttgtagctgggaacggtcctgagcccagaggaatgcgtcatgtggaacaatgtcttcatggaagtagccacctggctgcgttgctaaacccccttcgaaaattcgtaaacggagctggtcattctcccatagaggacgtccaaggacgttaaaggcgctctgtgtccagagaaaggtctctgctaggggcggattcgggatttcaggttccgacagcagcgagtctgtagacagtggcctagggcagagaagaagtcccgcccgaatgatgcgtggcttctcttggacgatctaaggcagaggttaatatgaagaaggatattaaacccattttgtgcgagatacactcacaccaacgttacccgccattcccaccacagtctggcccgaaggagccagaagcggtcgttggcagtggccgacagcagtttcgcccactgaaagggtggtcccggttgatgtccgaatctttttgagtaagcacctgcctgtacttcaagggaaagcacttaccgaaatgccctttggtgctgtgaaggtgcccggtgcctttggatatgtgtgtgatgcgcttggggccaaggggtctatcggtggaatatggaggatcatctcagcgatccattcatgtctctggaactcaagtgtccgctgttgcaaatcatgttctttgttgtcaaacccgaaaagccgtttctggccattaatagtgactgcaataccggttaggtagccttcactatcccagaacgtgtccaaagtcttggaggaatatagggcgtcccatgaggatatccaaaaggagtgggcgaaaagttggtcggaagaggcggtgggccacgacactatagaagtatagggagatgctgcattgtcttcgacggactcatcaacgtcgcccgctgaaacagcaatcttcgctcgataagactcggcgatctgcccacaggcgaaccatatccgacggcggttcgctactcccatgtatttacctttgaacccgagtcgtggtttgctcttcaagtttgcccacaggtagacagctttcatgctcgaaaccccgtctaagaatccgggtgattggagaacttcatggagctcgaaaaaccattccatttcgtccttaattctcctcatccagaaatcatggttgttgtgatgcgcagagtggagcgcccacgatgctttaaagagatccatgagcgaggtgtcatcaagagccgagaaaatctgatctgtgatttcgcgtgggagtttagagaatgggtccgatttcactttattgcccagggcttgatcaagggacgcaatgcccgtgccaagctgcagcttttcaatctctgttgtagagagtggtgccatccgtaacggggatacaacaaataattcttccccagcaatgctgtaccaagcctgttcaggtgtaggtctgaaatctgtgccagggaaggcgtaatcgaggttcaagcaggtcgaatcggcgagagagcacacgacgccatacatcacgtccttgttgatgagaccaatgtcgtctgagcctgtcaggtatcgggacaggagcttgaaacagtccatgtggaaagggaacacggggtcttcattgtcgttgtagtcaaaatagcagggcattgcctcgacctcgacgtcttcacaattgggatcatcaccctggtcgcaagtcatgactccaaggtcatcatagcatccctgcccggatatgaaggccctagatgattaagagtcagtctgaaagcatattgaagagattacttgaaatgtatctggatgtgacagcatacttgctcaaacgagtgcagtaggcgttaatcccaagcacgcgacaattttcagtccaatcgatatcggccggctggataactttggggtcatacagccaaccatcatcttcctcttcctcttcctcttcctcttcctcttcctcttcctcttcctcttctcgttggtcatgattttcttcggcctcgtcgtcttcttctctcacggtccgggggccagcgttggggtcttttacgtagttctcatgaccacggatacggacataggtcatgggcccgcaacaaaccatgcagtaacaatcccaggagcccatcttttattttatagtaagtcaagcgaaaaaacaatggcgcgttccaggtgaagagggaagtattcaatttatctgcgtgaatcgtcgtgaatttcgtgattaggcagttgccgaagctcaatcacgtgttgtaaacgcgcccagacgccaagacatccaacatggattgatttcatagattgaaattccaagccttatctagcatcgctatatgtcactcctattagacataatacgattcctgttaagcagtctagtcactccggttgttaattagacttccataaagagatgtagaaaagaggccttgagaagaacgttgttacataatgaccgcgcgaagttcgtttaaaggcgaattaatagtgccactaaatatagaactaaaaagagatcctgctctcaaaaagcccattaagacatgttaaagcaatgtcaacctcaatgagaagtgtctgtaacttcgcgtttggaaagcaagtagctatagggtagtcaattttgagggtcaatttcagtgcgaggcggatgactaatcaccaccgtgccctaacattttgggatcgcgtcgcgtctgtgcatcttcaccagcaccagagaagatgaagctgtagctccgcctacgatccaggcagtgactaggccggctattttttgggacaaatccgagacacatgtcaggtaaatgactccttgctcctgtccttccccttgggtgtaattcgctaacaatgatggtgtggtaaggaaagacgaaacacgacaccacgatgacctcctgccaagcacgataccgtgaccgagactcaatgtcctgatggtctcaattcaagtacccagctgtggcagcgcttcacaagatgtccagttccaccttgaaaccccgataagccgaatccgtagtcgacacccacgatctcctcgatatgcaaccccttccttgcgaacgacgctctcccgcgatgacatcattactctcaccaacttgaagcatcacttgcctgacgctggaagacgccttaagaaatctctagtgtctggtaagggatcgagctttaacaacgatcactacacccgtcagagacgcgatatctgctgaagttatgccgtgtctggtgcatgtcgagaccgccgtgaacaactacgcgacatagaaaaaaggctgcagtccgcgatgccccagcccgaaatgtatacgtgcctctatgtgatgttccccgtaacaaggatacaccaaactgcgagctactgcgctctcgtcactccccggctgctcagaattctagtgttgtccaaataatcagccgaagacgacacccgaatccggcatgttccgtgagtctccacgatggtacaatgtccctgtaggcggggagtcccaagtcaatcctacatgcgatgctgccccagctgaaagatcatccaattcttagctagccttcgcgtcattcactcaagaaccgggacgactgaatacgacggtctcaccagcctttcccccttacagagcttacggcagaagatcatcattctgccgatccatccagcagccactagacaattgattgaatcagagcagccgactgtctcaacgcgactgcccctcttcgcccgtgatgaattaataccgcaagtgccgaagagggccagggctgaacaaaattaggcacgaaataagaaagacgcacatgagactatgtgctctagactggatggtacaggggttgagaatcgtctcaaacctcttagctgtagggcaaagtggggagctgaaatctgctatcagatcagatcaaagttttttatctgatcatcagataattctgcttctctacggtggccggtcccgcatcaagcccatccttcatccatccacccacacacctcttcaatgtgaccctctggctgttccctgccaacaagaaatcactcaattctgattatcacatgtcttgatgctgctttagcattaggaaggcatgtaggggtggaatctaccactctagaccggccatcttaccaagtctgcgatatccggtgaagggggtttgcttcatgcgagctggcgcttactcgattggttagctgtccatacttgttgacaagggaagcgtctcgtgtgtttgccaagaaggaaaacatgcattgccggaagcttagtgccgaagtgaagcacttagacctgccacactccatatgctcatcaatccgtagcttgccaccagttactgggtgcttccccgcaagagtcttactcgatttttacataaagaggctgcctggcttcgcttacgcccccatgttgatttcaacattcgttttgtccctggcgcatgtgagcgagcagccacgctacaatgttcgcgcgctggcacttggtcctggtggcctccgtaggtgcagcatgggtggcacagaaggtgattaaactcatcattgtgcgacgatggtttaagaatctggtgagtactgatactgaatgaaaattactggaacaaggactcaccaacggcagcctcaaccgcctggccacaatttcctctctggccatctagcggccatgactgaagcctcgcaggctttcccgcccggaacacatccgcagtacttctatacctatctagcacacaagtacaagctgcctggaattttctacattgacctctggccgctggccgtgccgcagatcgtcatcaccgatcctgatatcgctatgcaggtgctcaccgtgaatccattcccaaagcatccgcagatcgaggtctttctccagccattcactgggaaaggaagcatagcagcgtcgaatggggaccgctggaagtataaccatcgcatggtcggtggcggtttcactgcgagccacatcaagtccatgataaccatgatctcggaggaaggcttcaccttccacaatcgcttcaaggagatggccgagcgcggggatgcaattgccctcgaggaagagacctcaaaggccatctttgatgtggttggaaagatcgtgttcggattttcgctcgaggctcagaagacagggtcgcctcttctcgaggatctcagggcgacgatcgaccctgccacggctgtcttgtcaagcttcaaccccatagctaggtacaagagctggcgtaagctgcgcgacattagaaagcgcgttcacgattccctcagcgccgagatcaggaagcgcgacgctattatgaaggacgagaaggagctcccgtcccgacgcaaggctaagagtatcatggaccggattatccttgatcgcatgcaggatgagcccaacgcgcccttgaaccaagagtttcttgacgatgtcatcaccaagtatgaacttcttccgtgactcagccacatgggtcaaatatctaacatgcatgcagtctcaaggctctcctactcggcggccacggcaccactactagcacgttcacatttgccatcatgttcttgagcctccactctgacatcttggctcggttgcgccaagagcacgacgagatcttcgacccggagttcgaaacgaccatcgaaattatcaactcagatccctcccggacaaacaagttggacctgacaaacgcagtgatcaaagaaacccttcgcttttacccaatcggattcaccatccgctccgccccaaccggtgtccagttcattgagcacaatgggaacaaatggcccgtggcgcatggcgcgatggtgatcccctcagcccacagcacccaaatggacgcctccttgtggaaagatcccaactgcttcaggccggaccgattcctcggggaggagggggcgagccagcaccggtttgcctggcgcccctttgagcggggtcccagggcgtgcatcgctcaggatctggccatggacgagctgagggtgatgctgctgctggtgatacggtggtatgactttgagcttgtcaacgaggcccagaacaagaagccgcgtgttgggtttatggatctggatgagaggattggggatctggcgttccaggtcgtggggatggaggcgaagccgaacaaggcaatgcggttcaaggttcggcctagcggaagatcttgagatggatggatctatatctttgtagctttcaactatatcgcatgtttaagaactaaacttcttgaaaggaatcgtttatgtgctcaattcagaatagggagtcctgtgaaccggtatatcattgctcatcatcccacggcaagtggccgtcataataacagggacagaattgttgtggtagacataatgatttttattgtgtgataatagctaattcgtttgtatataaataaagataataccatggaataactggtcaatattctattattattttacacagttatctatcattattcggattgtacaagaaagttgaaatataaaaccacttttgcagtccctgttattctgacacccacttgccgcgggtacttgtagtctaccattagacatggagttcccaagagacataggatgccctaagtatatactgtgagcccattcgtttactaactagtacacttcggattgttttattactactaggaaatactcattcatttgatgaggagctcaaggagacatacatctcatctacctcttcatgcaaggtctctatctgagattccaaaccaagagctttaataaaataaaccaaagagacagagaaaacaaaggcaaaaacaaaagggagcacaacacaaacgttggttttttccctctcctcgggcaatcatctcgtcatcttggaataatcccattgctgaaatcagggctagccagagcccaaaggcgcgtgagattgatcatgagggaatccctaggggttaaagagaaggaagagtcagagtgctagcatttgctcgttaggctgggctatacagtggtgtattatgatgccaattatcgcaacaaataattacaagtctgccattcatgttttataaggtgcttctgagtgatggtaagaagtcatcaggtaaccctgctagcatctttcaggggatgagctccccaatcttactgctaatttcgcctgcccgagttggccaagcctgaaaattctctgggtctctcaattcgtgaattctttcacgactaaaacactcataagctatcttcaatctacattttctttcttacaatacggtaacatcctacgaaacgtcatggcgctcgttccgcctcttcttcgtatgatgaccgttctggcgcattctctactcctcatcgtgttttcgccaagagctcaggccatcggcgtcagcgcacccagaaccatcacagccggccagaacgccaccatctcaatcaccgagacgatagacgaggactcggagcttcggagtaaatacgatggctatcgcctgtatctggcgctgacgccgccaggctggggcacggggccggagtgctggctcgcgaacaatctggatcttagcccgcagaccgtgaacatcgtaattcctacagacgtggcgccaaacaacaccgaggttcgcatcgcggatagcttcatcaagaagggcagtgaaaaagaaagcggttactcgtacagcagcaccgtcacgtttcttggtggtaatggcacctggagccagcgggagctgaacggacggagcatgaccaacgcgaacaggctgccttgctttcttctggggtgtgtgcggcaatgcaatgatcgctactacacgggagaagaatctagcgagaaggcagctgacgactgttccgagcagtgtctcaagaactccagagcatcgtcaatgaagcatctatccatggtcgcggtactgatgggaatcgtaacttgtggacttgctcagctagtattatagttcatcatccaaccctagatacaagacagttgtgaatgtgcagaaggtgagcggtggtgcgatattgatcaagtgctgggaataggtatatataatcaattaacggaaccgacgtcaccaatccactacagcaactgaacacagttgatcatcttccgtagtatagtggtcagtatgcaagcttgtcacgcttgagacccgggttcaattcccggcgggagagtccgccaccagcatcagctggtttcttttttttcccctttatctgtaattaatatgttaattccctgagtgattgatgtctttttgttgttcaaatttgcttcccattgttccgaaagcaagacagggcataggttgatcactcggggctgtgctggcagtagacgttaacctccttcctatatacgatttctgctactgcctgcctaaataccttgtgatagtaataatgtagatcattgctagtgatctttgctggatttggtgcattacgaaagtcactcgtatacactccagcctgcatcgggtggttatttataacacatgcatgactttgatcacttcagctaagtgaagacgtgaacctactgtccaatagacctcatcgcaaagtaaggtgcacgctgagcttcctcagtcagattttggggtgaaatggctcaggtgacagtcctacacccagttgcaccctgaaatccccggccattcattggttacaccctgaatcctgcggcttacttaccacaagtgtgccttgtgcggctgagctgcagcgaaaaataaagggaagaccattcccgctgtcagagcaccttagactattcctcaagttctcacgcactgcactggcgcgacatgttatcccgaatgaggtcccaagctaccttagccctggctgagtcaacatcatccacagacttggttcttagaggaacgatactcgaagaaagtcaagttcttgctgtcgttaatgcctgggctggcactcgaaaagtttctggcagtcagctcgtaagtcgagatcacgacaaagaaaaccactataacatctcgatacctcgcaaaggtcatagttcccaaggagagtcttcgtccagagtacccgccgatatcgatggccagtcggtccgtatgcccatgagccaatatgaattgatgaccgcagcgaaggacattttgtctgctctcgtacaattggaacgagaatgtatccagatcacacacacgtcaggcgaattcccagggcctgtctatgatgtgcataagcccagattgaaggccatcggctccgaacgtgatcgtctactagtcaagattcatgatcagcttattgataaccctcatccagctgctcgttctgctcaaaagaagttggcggcgaagtatgatatgacgcgaatgagaaaacgagctaagaggtatgaccggaacaatgcgcttgagacaaccgagcttggtgagttgtgccaattgctagtgaatttacagggacatgatactaacttcaaactctcattatctttctgttagagataccgaagaagccacttcatgagccatttcctgaattggatgagatacttaagatgatatttgaagtctgggagaggctcaataaatacttcgacaaagcgtgtgacgagcctagttacccaactattctggatgatttgtgcctcgaatttccacacgccgtacggcatttatgtacaaccatgccgtggacgatttggcccgctctgatagtactatggggtgtctgttggatgtttaagccatccgtgttcaagccatccgtgacggaacccatgttctccattcgtcggtgtgccacgcccctctcaaacctagagctggattttgacacctcgcaacgtaagtgctgtgacgttcccatactattttagcattcgctaattcaagtctctcaagtgaagcccgcaagtctttttgattcccaggattcgtacctgctggacttcgaccccaatccttcttggttcgaaagtgatagcctgggatatggatatgagcctcagagtattgataactctgcgtcacacagtagtgacatgggtgacttagggatggagaccttcgatcatattgctgtctctgatgcgagtttgcttcaagattcctcgccgaaccacgctcaaggctccagccaggagaacacatcgtccgaaagttattctagtggtgaaggagagagcaacggaccctcggcttctgaaacttacgatatgacaccaagccatctttccaggtaggtttaaagcccatcgaggctcgtaccctagtgatgcgtgggaaatttgtaactgactcgattaaaagtaacgaagaggaaccttcattgatctgcgagcaatgtaaggagactttctcgaacgttttcacactccagcgacaccaggcagagcaacatgctggtggcccgaacagattcccttgcccccatccaccctgcaaaagatcccaggccggtcatgcttttaaacgagaagctcatttgagaagacatctcgaatctcgcaagcatcaatctcctgctcggagggttttgtcaaatgttgcaatcagtccaagcttgacttccaacctaaggcccatcatctcaaatgagagtagggaaatgtgctctcgcccaccccaggtagatcggtcgaaaattatagaacaaagtgaggaatgcaagagtgatgacttagttcataagtggaagaaggaatacgaggtcgggatgaaagctctccaggcaaaggagcaagaatgcgagcaaataagacagttactgaaagctaaggaattggaatgtcagaaggagcggcagttattggatgggctcgcgaaacttgtgcagaattaatactctaggaagggacttatagctattatgttttgggtttttgtctgatttctcatgaggttattgtagcgacgggtttaagaaatgcccttaataaactggcttcgcaaaactgcgcgctggttctttgcgtcccataaacattcaccccaacctgataaaaagtagtcaatctccaacacgaaattccttcacctaaaacatggttgcactattgattcccgcagaagataaccaaaaaaaagtagatgagccaccaaaactcctaggctatctggtagtcgatctctctccgtctccttctccatcttttccgtccttggaatttcttcttttctttttcttcagttttggacgaagatagcatgtggcgacagatagaagggcaacaaatgctaggacgccaatgacaattccagcaattgcgcctcctgataacttatttcccttttcaccatcgccatcgtcgtcatcttctcgaaatgatagtgagggctgattttcaattgtcgagatatgcggtagggcagcggacagtaccaggggcaacgctgccacaaggaggaaaagttgaagagtaaattgtctggagacgatcatctcgccgggtatcattttcatcaaaacattgaggattcaaaatgtatttcttcattcaagacttctatgggtgttttataatgtgtaatgctaatgggtatctttgtttctgagtttttgatgtgggccggagatacgaagcgcataaacttggcagcggcttatccaagctacgcctccttgacaacgtaatccgatcttcaaaggaacctgggccatctttcaaatcgcgatgaagcttaaaggggaacaatcaatttcaattgccttgaaatgcgtgtagtgctcgtatgaggattgattctctgttatttccttcatttttctctgttcagtatttgaccatgaatgcggagagatgttgctggctgtgattgcgtttaaaccataattgttatcattgccatataatataccatgctatagatcccttcggtttcactaaccgaaagggcttacgtactatggcgaaaatgtcgtgctggctccctaaggagagcccaccttcatggatgcccatatgccaggaggaagacttgattccgagtctagagccctcagcttttgataatgtgtactaagcctgatatcgaggagtttggtggttctcccttcactccttcctctcggccgcaacgctcctctcttctattcttccctttacccaacattcacattgagccagagcaacatccgcatcattcttgtgcattaacagaaaagagataatctccgcctggctgaatgttgctggcggaaccattgatgcaaacttggcagcttttgctcccatcacatcctgctctttcctgtccacgctgccgtcttcaaatccaccatctcgattggcttgaccaagaagaaagctgaaaagatcagcaatgaccttgcagtcggcaacaggcagctctatctgcatgtcgacgcgaccggggcggatcagcgcctcgtcgaggttctcgcggtggtttgtggtcatgacaacgatccggccgtcttgggatgtaacgccgtccaaggtgttcaagagtcccgacagtgtcactgagccccgacctcggcgactaactcttgccggcaccacatcctcaatgttctcaggatccgaggttctcgacacaccaacggcgtcaatgtcttctagaagcacgatgcatgtatcgggtagactttcaaacaggttcttgagagtgctgttggtaatgtctgggacgttgatcacatagacgtccaggtcaagctcacctgccatagcgaagctgagactggatttgccagtgccgggtggtccgtaaagaaggtatccacggcggtatggtagtgcacgctgagtataccaaagacgtgtctcctcgcttagaaaaccttgtatatcgctgagaaattgctgcttccgctcatggtcgatgatgacggttgacaacgggcgtatgtccttatccttgagcttcttccagctcgaatgattgttttcaaatatcgatgtcttgcccctgatttgctcaagatactccttacgacactcctgcatcaattgcttgaggatcttgttggaccagcctaggcagctgagcgttgtctgttcctcggtcccgcgatcgcctcccttgtcgacgtattggttcttgtatgatatcatggaacctttataccaaaaggtaaaagatgtccgccagggcttatattcgagggccttcttgccgccgtttctggaaacatcgccgggatgactcttcttcgaaacgctgacagaacacgccccggccgagccctccaacccgcgccgtttcaaccaggcgaacagcatctcagatgcctcgtccggctggctgatatgtaaagtcatggcttgtgatactacggttagcttattgataaaataataattaggagggaggatgacaaaccaaaatgcgacttcaacatcctaagaagacgattaatataggtttgcacaaatccgatcaggcccagagcgcatgcgatataagcaaaaatattcaaatcgcctgcaagaactgtagataacccaccgagcatgcgagaaatgccggggaggaagacttcgagcgccgagacatggtggaacggggtcgaacgccgtgctcctgagtttgtttgatccatttctgtggccgaagcgagaaagaggtattccaaaagatttgagatgaataggatagagagatctgatgcgaaaccgaaaatttatatgtcgataggttgcatgtcaagtgggaaaggatatgcatagagtttggccctgttgggtagcacatcgcgagcatttaggcaacagctcgctgaatagccccaacgcttattggcttgttgctgatcgggcgatcattactctgcatacacgattcggagagatcgcaagatccgatgtaggcgtatctttaaactagtaggcgggatttgcgcgtgtcgggctttatccaagggttgttcgggattgccactctacacttattgtctattcagtattgattggtttaatatattgtctagataattttctttccgcttggttgcagccttgggctggcagagcttatttttgcttttcgtattcattgtgttgagacgtcgcctctggcatcttccattgctgttcttaactttgtactcagactcacccatatcattttgatacagcaaagactggtcaattggtgtaatacgggagagagctcgggtgtaaagttaaagacagcaatagaagatgctagatccgacgaatttgtggtaagataacgatctaatattccatcatgcttgagcgaggagtcacgaatccagttctgaggtagaggtttgcacacctaagcctccagtctataggagtccaagataactctctaaaatagtgataggttgggtaattcgccaacaatattatgttctggtatgagcttgatgcatcgtcataatttcgacagggccctttcatctcttaacacaacccgactccaatcagactccagttgctgggccacccaaaaatacgaaacccatagctagaaagtaacctcgacaagaatatatacaaagaaaagaaaacataacaacggagcattgaagacccggctacaaattgtattcaatcaattgtaatgcgttgcttgttgcatttctggctgagaaggctgggccgctctgctcggctgaggcgggctgaatacctgcatcgccccgtcgtatgttcgaagcgcaagtttttggttgcaattagtgcaatagtattcggtattctcacaccagtgcaggatgcagggcaggcatgtgaggcagacacagaatagacagagaacagcacccacaacactgagaaacagttagcagagtgatttgtataggcttaagagcagttcagtaaatataatatggcgtcgtacatttgcatagaaccgcctttcttgttcagtctcgtttgggcccggcggttgcaaaaggggcagtcgatgaattgcggatgatctccaagtgaggccaagggagtgaccatttgcggagccccagcgggatgaccattggatgtgctacaaatcaattactgttaacatggttcaactgtctacccgacctgattgctcgtagatatggaaaagtaaggaggttcagaaacctactcaaaatgaactggtacattagcacctcctttagtggattgagtttcatatgtcggcggcgggaccggcaagacttggtcctgggtggccatggctggcggagggtggttattaatcccagcagatatgggctgttctgaagttggctgttgttgatacatgctcgatgaagtaccttcaagtgcaaagaagttggaacaccgagaccagccagaaaaacagcggacaggatatgtattcctgatattaatactccaagcccccttaccagttggcaaataggagaacctaatgagcaggtcagctaacatgggccacggaaggcgccgcatgcgttgtgcctcgcccattccgcttctgccactataaccaacagccgtgtaacagttgatactacgtatcgacggaccaatacccaaacgactaactgccatttaggactaaggcatctagtgtggcgcccaagatctggcatgatcttgccgagactggaaccttgatttggcccctggatcactcgtgaccacacagacattgaagggaactaactacttcaagagcaacctgcaaattgagttaataccaccattgagccagacgcctttcgggcctggaccctagtcttcgggcggaccatgttgcccagtacagccacgctgtgggcgacgaactcggcattctccttatattgccaccctccatcttggcggtatctaaccaccacttctggcaggcaagcctgggaacaaaagatcttttctatgacaacattggccaagcatttaaagcgagatcatgcgaacatccccgtagacctgtcttctgacctccctccgtaaatatataattggatgtggcttacaaggttgaatcggagccttgggggcaaaggaatagttccatggatatcaccaaacaaaaccaaaattcagcaaatctcacctgatattcgctgctgccaagaaatgaattgagttcaaatataggacgcgtatgggggtggcgcatgccaggattccagaggcttgggaaatatgccagcgcttcgccatcgtccatcaccccactaattatgacgatatcaccctccaaaatgagttgcagggatcggcagagctgacaggcgtggatatgtggctgcgccgccattgaactttgggtctcagagtaggcgccaccactcatgcaacacgaagtcagcttggaagccgaaacaataggttttcagctttggtgaaattaaactttcatatgccctaattcagagcaaccattacaggcttggggtttggctctcccgactcccgaatccaaatacgtcagctgtatatgtatagtttcttctcaaccaatttctcaaccctctccataaagtctatggctcttatctttgaaggacttagtgggtatacgacgggttctactacgagactgtggaaatattgggagtcttatatccctataggtcatgtgacatttcacgccgcggatgggagacaaaagggtgtaatcctatccaatgcaagatatatgtaatcaatttgccatcagttgagaatttctaagaatgggagcttaggcaccccaaaaaaaattgcgcaactggcacgacaattggatatggcaaacattagcaagatggaatagcaataccacttcacttcttgcctctcttgattaattcacatcgatataattcccagttgatggagtttatcgtcccgacagtatagtacccatacgaaagtcgcgggtacatctcctgccttggagcgctctagctgtcttgtgttcgggcagcaacttcctcaaagcctttttcttggcatctttggaaaagttttcaacaaatgcacgatcctcttctgacagttcgcttagacgctcagtatgactaaacttatcgggctgtttctcattctgagagacgatcgaggcacctaagagagtttgagtagaacgttaaaataaaaatagaagatgccagaccggacaactcaatacaatgaatacgaaaggttaataaaaaagcttcgctagcccaagactgcagtcatagggaagaaaccgatgactcacttaccgtcaggatgagctgcacgtcgaataactattaaaattgccctcttcacctagcttcttatcttacaccaatccaaacacttcaaaacaccaagcgagagcccttttccctaattctagtggcggacccgtccagagacgcacgcaagaataccaaccaccagtaagtaccagtagccccttggccagagcactgatactaatatatccgcagccttctctatttatcccgatcatcagcgcacattataacaaagaacgatatctcagtaccttttctcaaagacaataagattacctgcctaaatatattaaggcctaaggtcagcaccagcaacccgaagcttactatcttcataaaggccatcgaaaccaacaaggttgataagctggatcaaactaagctcagcagcctctctgcagaacatgtctcagccctgtatacctctgggcaagatatccttgggcgtgtgcctcgatgaactcgataccaatatcatctcggtccctcactgtgttgtcttgcattgtttttaaaggttaaaaatccttttcttattaacgatatcctctttcgaaccctgatttcttctacgtcttttcctctatactaatgtcatgctggcctacttgctcctctcggtgacggcatgcttctggaatgactctgccttgggcacgaaaaattggaaacactccaactccttgctcctcaacgccgagatgacattgctatcgaggaaaaaatgtggaagaaatcagggctcgaaaaaggatagtggtaataaaaaggggttttaacctttaaacacaatgcaagacaacacagcacaatcgaggcacgcttactcatagtctcgatattctgagccatggcggtaaccagagactctttgttgacagagttgatggtagactcgaggttacagtagatgaggttatccaagaattgcttttcgatcttcgagtgttaacgaaccggttcgtcgagagggtttcggaatgaagattgtcttgcaaccttatacgttgtcgaaggaggttaccgggctccgatgacatcaacagcgagcgttggccttgcaacagggaagcataccgacagtctagatggctcgaactacatgcaagttcctgcacaatacagcaatgatggggaagttgctacgaatgagcaaccccagaatctcgtcagagtcattcgctgccaccattgatgggactagtgaacatgtagcttggcgcggcaaacagaatgtgttcgagcattcatctggagtcggaattcctagaagggttgagctggtgaagtaattccgacggtggagtgtcggcatttcagagattccgacataacgcaacccacggtcagatcaagcagataaaattccgacccaagagccgacactaaaccatgcttactttgtaggtagttagcatccatgagttagatattgtttagcaagaaagagagtagcatgcatctgcgacagaggggatgctttagtataagaactaatcccgacgatttgggcatatcgatttatacagtaatgccgacctcttaggcgaacgaagccgatagcgagcggctctgtgcataaaccaatatccgaaccctgctcggatttctctaggaagcggagagcattgatgttatattgagaaacggctgtagaatatacccgccgcgagtgagaatattaccggccacggctccttaaagcttgaaggaaaacccaagaatacataggctatcttgattaaaaataccctcacctagagcaaaaccttatacatgaaccttcagagaaacaaactatatcgttggttaggagcaatcaatttgtcttctcaaaaacgtcctaaatggctggcagcacgaatggtagtgccacccgcaactccaacggcaaccttgccacccttgaggagcctagcttcgcgacctacccagatctcaatggcaaagttgttttctgtatgtattgcagaacctcttttccccctcgtaatggaatggagagacggagcagaccatagatcacccgctaactaacgtattgctcagtaactggtattggccagaccggcgaccagcatatgtgggggaatggtgctgccaccgcccgtattctggccaagcaaggggccaagattttcggatgtgacctgtaccttgaagctgctgagcacactcgaaagcgtattgccgccgagggcggtgacattactgttgtatctgccgatgtcactagcgacgagagtgtgaaaaaagctgttgatgcctgcatcgagaaatatggccgcattgatattctcgtcaagtaagttgcaagacctatctgactcaaaggtaacttcgtttagcttttactaatacttctcccactataaagcaatgttggtcgctctgagccgggtggccccgttgagatgaaggagaaggtctgggacgcccagaccaatgtcaacctcaagtccgtctacctctgctgccatcatgtgttgccattgatggaggcgcagggcggaggcgccgtggtcaacgtggcctccattgctggcctccggtatatcggcaagccccaggtggcgtatgccgcaaccaaggctgctgtgatccagttcaccaaggctaccgccgtcatctacgcccccaagaacatccggatgaatgttgtagtacctggtctgatgcatacaccgctggtcggaatgctcgccgacaaatatgccgcaggagacttgcaagggttcattgctaagcgaaacaaggccgtgcccatgggaaagatgggtgactcgttcgatgtggctatgacggctgtcttcttggcttctcaacaggctagatatatcaccggacagaagattgtggttgatggcggtatcacctcgtcgactggctaatagattattaattgtcgtgtaccaaaatagacagcttgcttcttaatacaataaagattcgaagacgagacagaaaatcatgatgtttcaatgttcctccgtcaatcgtattactgaaatagatcgaaaccctctattcctaagttttcaggcaaggcagcactgtcgaatccaatgtccataatcacgtccagaccattgttcaacccgaatgtttccatggcgtgttgctcctccaggatgaattagaacgaatcataagattagaggcagggcgatctgacttacaaacgcagaatatggtccgggagccgctctttccggttcatcatgaggagccaattggaaaaccggcaggtctgtatcatcgttccccaatactggcccatgaggggatgaaacatcgccatgtgctgctacggtattgctgggcgagttgaggatccgaagagcctcgacccttgcgcgggattcctgtattacagcatggtcagcaatcgacgtggaggtcatgtatgtcaagtcgtccaagggagtgtctcaatctaggaggatgtaaaatgatgggagttttacatcaagtagtttctgggcgtagatgttgacactgttatcaagtttgcgatgaaccttcatcgccttctcaaccgcagactcaatattattccagtcgtccgactcctggtacaacgccaagtagaccaagagaatggaaatcgcacagaatatgaagtgagaggtcatctgaacattcatgatcagcaagctcctatgcagtcatagtgtctttgatgtacatacccagaaagtcgcattatatttgaattcatcagccccaaaatctgcagcaagagcaatcatggccatggcgttgtcgacgcatttcctgacacgctcggggcactggcctgaacgcggggtactgggagcctgctgaagaaactccctaagcagaaaatggcgataaataagcatgttagtaaagaagaaagcggctcgtatggttctttgctggcgccgaaagatccaaggaacgtcgtaaaatccctgctcgagggagctcatttcattttgaataggatggaagaattctggaacgtcgttgagccagttcttgagttctttctctaactcggccacagtagcttctgtaggggcagtgttatttctggcggctggatatagctgtgtgactatgtgacccataatcatagtaagtctatctcattgggtatcagtttgagaaggccacatcgtgcaactagttgatggacatacctaaaatgagctacgacgcctacccataatttctcctcaagattaccaagtcgagacctggtggcaggatcaagttccatggagagcgtgatggtaatatcgtgctcctgaatcgatatgggtctgcccaaggcaatggccagatatctaagagattgagcatcaaaaatacgcaccaagcaataatcgaggaagggtatagcttaccgatcaaccatgaacatagagtacaatatggactttctaaaatgggcttcttgagctgtgcacgcggttggctctctttgaatatccatcatctgacccaagcggattgtcaatcccaatgtcatccaggcactgttgaactggctcgaagcgatctctaattggcactatacgtagaaagtaagcttgttgagcatacaaaaaagaagaagttaatgaatcgtcatgttatagtacctttaggagttgggcttgtaaaatggctagggttgggggaaacgtgtttcgagaattttcgagcctgagttcagctgcttgtagaaagcgttccctgtaattgtcttaggtattaaataaaggtcttccgtgatatagatgcttcttacgattttcctttccaaggtggcaatggctcgtttctccaggatgccgtccatatgcatctgtcaggttagcttctcattaagcacatggaccgaaggccgacatacccaatgcccataatcaggagcacgatagccatgtccgtatcatcactcattacagtttcgttctccgcatagacttgccttaggagctcgtacatctctgcctttggcacataccggtaggtagtgtttgcatggtcaaagaaacagtcaaagtaacctttagcggtctcaatgctcggtagaacaaaagtgatggcctgggtactggggtgaagaccgccttgttccttgctgaacagattccgaggaagaccgcgaccgacctgtgctagatgcccagagaccttttgtagaaaggcgtggacgctcgcatcacctgttactccaatcagtccacatctttcagggagaagggagagtgtgagacaacgcgagactgacaagaacatacccgaatcatgttcaattctaacggtgcctatgtcgtcgctgttggcgtttgagggagcagccacttgagaaggcgacgccggcacaactgacgtatcatcgccagctacattcaacggggcttggctctgagccaagctgcgagtctacaggccgtcagctttctgcagttcttcaagtagaccaactgagtaggtagttttcttactgtcctgcgcctggctccacgtttgtagtctgaattataagcacagcctaggttcaagatgtcagtgatatgccatcgatgctactcgccttgtgaggtgataagagcacgtacgaagcccggaaccgaggcagcgctggcagggctcacagccgtcacatttggattttctttttttgcatcggtcacaggccctgtttccactagtcagttcaggctggggcggaattgactggttatgtcaacttgaggtgcgtggcgaggtggcaacgaaccttgtgacgtatttcttcttcggcacggggcttgggattgatgccattgagtcagatagtagtacgccctggcaattagcataaaaataggctagataacactgggcaggaagcctaaggttgcatctgccgtaaggatcagacaccgcctgaacttggatgattggggtaagtcgtcggctgtgtaggtagcttgtgttttcagtgaggggcttcaaaagcctgtcgagtcatccgccaattatccaaacggtctaggcttggggttcgtctgtggggggatgagactggggctttcatctccgcaacccatcccgggcaacccttcctctcccccttcctcctcactggatagcccacgccgttgacgagtcagttgggaaggggagcagattcaagggtgttaatttatttgcattctataggtttctaagctttgtctgctgaatcgaacacttctaccatgagtctctcaaccccttttgaatacgcctcgacggcttctacctgcagggtggtcaattcgaccttggtgcagttttctgcaatgtactcgtgatacccattcctcacgtttcggttttgattgaccttgaccattcctcgtgccattcccactcggaccatctcatctgacagcgggtgagtgccatgtagaacgagtggtgttgcatcacccaaagccacgtggatcttctccaacctgtccaatctccagtgcttctctgcgcctccagtggggtatgggccatggacattcccaaagctaggggctaggaaatgaacaccggtcttcttaacaaagtcggcggccatgtctgggtcggtaaagacactttccaggtcaatcgtcggcagcccgtcctcccctccctccattctcccaagctcagcctcaacggtgatgcccctgtccttggctctatccacgacggatttgacgtacttgatgttgccctcctcatcatacatggacccgtcaaccatgatggagtcgaacgcgcactccaaggccaggtccgcatcactgggcttcaaacaatggtctagatgaatggatataggcactgaagccgcatgggcaacctcggctgcatatttgatgaatgcagggccgtggaagtgcaaggtccatgggaagaattggatcattgcgggggaacgacatcgctccgccgccttaatcactgcaagaacgccttccgcattgtacctgtcattgtataaagtcagtctatgtcgttcactttgcatcactcggataatgggcatatgagcatgtagcagatgcttgggctaaacttacacgcagaacccgccaatggcatacccacccttccgggcgttatggataatctgccacgttcggttgttctcgggatacgcaaccattctggagaataacaagtgtttctgtctgatggtgtgctggaactatgaccggcaaagtgcctcctaccctggccttttcaatcacgcgccggctattagattccatcatgaaaaggccaaggataatacaaatcggatatgataactttagcttgatgccagagtcaaagccgacctgcatttgcttgacgagccccaccacaaggcgcgcgacaccatttccgactctgacgatgaattccgatggcagaattccgacaacatcatttcacttagtccgatctagcaggtagccaagcatcaggctggcaccggctccaattcaattcgcagcaactctcggtcgtcggcggataactcttatccgatggaaaagcgtcaggcccaccagcacgccggatccggtgatggcttcaagatgcggaggcgaggatccatgaaataccccagatatgaccagtcccgcggcatttggaggctcgatggcagatgacaacatacgaagatgacagccaaacactttgtcggtggcagccctgccgaattggtggtagatgcgcttgagagtcttgctcgcctgcgaccaggaatcgaatttgatagacagcacaaaagtatgaatcagtcttgacctacttcatggtaaaaatgagttcttaattattgacaattgaactgcagtcgtctactcaacgctccatgacccctccaagcatgtcgcactcgtctccggcggcggcgcaggccacgagcctgcccatgccatgtacgtcggcccaggcatgctgagcgccgccgtctcaggcaacatctttgcctcaccgagcgtgaaccagatctacagctgcatccgcaacgccaacggggatgccgggaccgtcctcatcgtgaagaactacacgggagacatcttccacttccaccaggcggcgcagaaactccgtgccgagctggggataaaagttgaggttgttgtcgttggcgacgatgttgctcttcagaagagtaaggctggtaaagtcgggaggagagggttggccggtaccgtgctgatgcacaagatcttgggcgctgcctcggcggctggcaagtctctcgaggctgtggtcgagttatcgaagaaagtgaacgctggtttggccacggtcggtgcctcacttgaccatgttgatattcctggccagagcacagatgctcagattcacctcgcggcagatgagcttgagctgggcatgggaattcataacgaacccggggctgagttgctgaagccgaagccagaactcaacgacttgcttgacaggatgctaggctatcttctggataccagtgattcagagcgggcgtatgttaatgttgctccatctgatgatgtggttttgatggtgaacaatctggggtcgctgtccgttctggagcttggcgcaattactaccaatgtcacgcggcgactaggtatgacccgtcaaacaaatattgaagcccgcgtttaggggtgctaacagttcttaggaaaccgcgggatcaatcccgtaagaacatacagcggaacctttatgacgagcttgaacgggcctggctttagcatcaccttgctcaaagcagattcagaacttctacagtatcttgacgctcctacatcagcggtcggctggtccgtcccttatatttccccagaagagcgaaacgcgaccggcagagtcattgcgactcagtcaactgagagcaacgtggaaaccgtcaccaagagcacatcaagtgcgaagggtaagtagtctcttgaatgaaaaggcacttgcagtgtatttgctaacaatgccctggatcaagttgatggaaaattggtgcgttcagttatcagcagcgcctgccgtgctgcaattgctgccgaaccgtccatcaccgaggctgacaccattgttggcgatggcgattgtggcctgacactcaagcgtggcagcgaggcggtgttgaaactagtaaaagacccttcagcctccgaggacaatatccttgatcttatgattaagatcgctcacgaagttgaagaaaacatggatggcacctctggagctatctacgctttgttcttcagcgggcttgctgctaagctgagagatttggatagttcggtgacaatgggcctgcaggaatgggctttagttgcgctcggaggactggagactgtccagcaggtcacgcctgctcgggctggggaccggactttgatggacgctttggaaccatttgtcgaatcactcaaatccggaatcaatcagggagtagaagccgcaagaaagggatcggaatcaaccaaggggttgaaaccggcgtttggaagggctgtctatgtcaatgaacagggctgggagcaggtcccagatcccggagccatgagcatactcgcgatcgtagagggtatttcaaaggctttagctggtagccaataactcctagatatagataaatttgggttgtcgatgcaagagtcggatcatttgccaatacggtataccagttgagaaagaacaaaatatcaaaacactcatgggtcgagactaacattttccaaggccgttgtgggccaacacgtggctggacagagtctattgaagatcacactgggtcgcaaaaagtagataatgtttcatatcgagattgtcagcttctcaagcctgggtatagcggtgttagccacggaggaaaggaccaaattttatatcaatatcttttgtcctcgtcagcctcccgcaaagcaccctctatgtctatatcatcgagagacaagaacctcgttttcttgtagaacttccaaaagagaaatgccgcgagcactagcgggaaatccctactcaggtcagtatgcaatgtaaaacagatcgcttcttgtcattgcttacaagtaggatgacacaaaggagctggggtcccagtttcctttggtgaaaactgtgaatccgctcgtgagaataatgatgaaacacattcccaaagcggcgattgagctatgcactgaaaccaccagttagtcacggttagttctgtgttgtgagctgctcggactctctgttatcacttacaagagaaacggtttccccatgggagccgcgtataagggatgttttgcttcttcagggccagccgtagacggatgtggttgaataaaatggttgaccaagaaacgagtgttccggccgacgtcaagctaaccagccaccagaagacagtgatcgcaccattcgagagactcatgaagctgaggaacatgacggcggtgtatagagagacgcagacatacggggcaccccagctcgtggtacgcaagaagatacggggcgcatggcccttgagagcgagaccgtaaagcacacgggttccagacagcagactctggttcgacgcggaccaggcggaagtgatcacaatagcgtttacaacacttggaatagcaggaattccagctgctgaagccgcaataacgaagggtgaagcagttacgtcactgccgtcgttgttgagacgctcgtcatcactcgggaccagcataccgacaatcaagattgccagcaggtaaaagacaaggactcgaatgaacacgtttttgcaggctctcgggatggccttgcgcgggttgcgtgtctccgcggctgccatggcgatcgactcggtgccagcaaaagaaaacaccgcgcccgtcatgacagaccagtaccccagaaactcaccccagtggcctgttccaatatattccgcccatgggccgggcgaataccagtacttgaaaccgatccgtggcgttcctggcacgccgcccaggttgataacaagaccgagaatgatgagaaagatgacgaggagaatcttaagccagccaaagatgtactcgacctcaccaaaaacccgaacaagagaaaagccaacggcgaccgtgaggaccatgaagatgacaatgaacacggcagggctgaggtccgtccagtactgaaacagcacgcagatagccgtgatctccgccgggatggacaaagacgtcccgtaaaccagattccaacccactgcgaatccaagcgcaggatcgacgagaaactcggcgtggcggacgaacgcaccggttacgggcatgagggcggcgacctctcccagcgcaaactgcaccgcgcacacgaccaggccgaccgtcgcatacgcgagcagcgcaccagctgggccggctttctgcactgaagacccgagaccgaggaagagcccggtgccgatggctccggcgatacccagcatggcgacatggcgctcggagagaccacgcttcaggtcgcgctcctcgttggtggtggcaatggtggcattgtgcccgttgttgtggacttcggcagtctctgtcacctcttcgtctttggtggggtaagactgatgcagccagggcgagtggttggcagccatggcttccctcagatggtcgtcgagtcgtgtgagggaggacgttcaccgtgggctcagttggttcgggaggactttaagggttggtgtcgtgtgctgacttcgagaaatcaggaccaggatggatgagatagatagcgccatcgccatgacaggcaaggatggtgccatcattcctgcagcatcctcaccaatggcctcgacctctgcgggggttgaactacgttgtggcacggtcctctgttcaacgggactgggatggaaccttgactttttcagaattacacataacaaccttagacctgccgccagagtgatttcttaattccagtccttaattccttcatctctgtgctaagatctgttgcatggttgttcccatccagaaggaccagaacatctgcccgttcaccctttgctcttcaaggctgtctaagtggcaaaatctttttgtactcatcagaaaaattcagacacgcggctggacccgacgacgaaccggattgatctctcatttccgagccgcgtggagcagggatgtcattaagccccgtccaacaatagctccctcggcccaaatcagaaggtaaacttcatcgtcctctggatatcctatggcaaagcttacgaaacccgattcaactcggtatgtattttccatctagcagcctggatctcgctttgagaggaatcatgatatctagacaaaggccgcccgtaatcgaggggcgatcaaggggttgccccacgactgataaagaccaattttcgctgcacagattccgtgaatggagcctctttatcggcccgttgcgggttttgctcagctcttgataacaatcttgttgccaccattggaccagggtcgcgtatccgctcacagggacttgtcaaatgcaaatggaatattgcgaacacacatgagcagtgacatgtatcagcaagcgtcgtgtatgggcgagtcaagatcggcactaggtaataatgccatcaactagcaaatatctaccaatgggacagttagtcaaggcctctcggtaaggcctgtcggtgagtaattgggtagcctccatcttacacaaggggagtgattaccctatacctgtatatgccaccgggcagctgcctaatgaactcgcactctgtcatgccagtgaaaaccacgcctttaaaaacttgaatggtgcagaaattcgatcagattctagcaaaatgagcgtattccgcatgaatatgagttggacaggctgctgttatgccaatgaaaatcaaaacttagtatacgacgatacttgaagcttcgcccttcgtgcgaaattttagatacaaagtaatacgcttctttctacattgaacacagtaagtttcatttcaaacggttcaggcatactcgattaccacttaagctagatcttcaaatattaaaactgtatacaccactatcggggctgctttcaaaagcggctgatgccgtctctgccacttatatgccattcctctaactgggttctagcaaccgtgagtccgttgtatgattcgtacattaagcatcccgggttaacaaagttgcaaacacctcatttggaatgtccaagatttaggatgggaaatctccaaccacactgtttaaaagcccgttgatgtatccttccgatatgccagcatcagatataagagccatccattgcgcgagcccgtcctctggagaattttgaggctccggtgtagcgtcagacagagcactcaatccactaggcttatcatccatcatcataatggtgcgcttggccagcgtttcaaacgtgtcgcggtagggagcggcggccttccaccgctccgccatcagcaccaacataatcgtacagtctgtgcaaacgctactcacccgaccttgccgataagtgtctcggacattaggcgaagtccacaaacagtgcagaaaggtcagccctgcgagaaaaagctcgtggagtccagtccaggtatagctagttggctttccgagatattgagaccggtagctgtggcatatggactctgcggcgcgcatgcaatccaggaacacgctctcgacggtcccagagtggtgtattatttgtgacctgtatagttgaaggatggtatagttgtattccatctcaaaccagtctgatgtctggaacagtgctagggcttcggtacagggtggcagaggtgggattccggcgcgccaattctcaatctcggctcggaatttctggacctgctcaagatgagaatgctttggtgggcaacatgatttggaattggaatacaaagtggtgtgtaggtgggctaaaatgtgtcggatccggaatgtgtgaatcgcccgcgtcatgcttgttggcggatcagttggcgactgccgcgacgagtaacagggtccgctgtctgggatgtcggcgtcgtcaatatcagttggatactgaattttcttgttagatctgactgaagataatcctccaaagtaatgaacagtgaatcaaagcattgacaaatcttacttcagcgtcaacctcgtgataaggtatcccttgtggtcgcccaagcatgatggctgcctgggactccattgcatacgtgcaccagaatactcttctgtgcaattccagttgtagcggatcgtcagtcgacccgaaggtcttggagttacggtgatagcctcggtcgatacactgtcgcagggccagcccggccaatttcctggcctttgtgagtgttactctgttccagtagacccagctaaattatgtcttaccagtgggatgtaccaatggaggagcgtagagaatataccgcgcaacacaggatcgcttggatcgattctatattatccagcgccaggacttgatcgctgtatgcctgtgcagagacataaagtccctaatgtgaggttggtcatgctgtgatccctatttggcgcgaatacacttcaggagcatacctcagctgagtacccataagttggcaatatcaaagccccaacggcatacacctgccaacggaaatcagtcatttcgctctcaactaaagtataaaccggagcattaccatatggaggaagaagagcgcgacggggtcagaggtcacgtcgtcaaattcgactagcccgctgacgatagagagctcccattctctgaacgttggttcgtgaaggaacgggtactgggggtggatattatgaaaataggcgtcgctcagtgttaccgccgtgccgtagtcggggaggaggcatggaatagggtgtgtaggtgaattattcgaatgctgatccaaggcggaacctgaatgtctctccgcgacaaggccgcgcaacgaagagttgagaagccgggagaaagcaaatgttgatgatgagcccaggtagtgaggctcggcaccagcggcgctgagactcaacagacctactttggatgacagctcatcaagcccagtctccccacgctgctcctcgtccttgtatctgcgtgagtgagtagagtgggagccttcagtgggcagggaggcggcggggccattaaactgagaatccggttcagaaggcgcgctatggaaaagatggtcattcgcaagatctgggcgatggtgtttgagagtctcttcgaggaatgcaactcgctgctccaggagctcgaggtaattccgaggccgatgctttctcgttgctggatcctctaccaggcaggctgtctggcgtcgtcagtaagagatgccagaagggaccatgggccaattgaatagggaggtaagactgtactgacagatctctgcgcggcgacaattttcacagccagatatgttgttgtcacactggatgcacgctctgttagtacaatgcagcgtaaagtgaagctaggtccatgtcccactttcagtttcttctccttgcagttgacgcaggccatcaacgtcctgtttgccgatcggactcgtttggggcttcgataagcccgaagacttgcttctcttgcattcggaaacatggtgcgggtggaggttggagcgaagttgacaagttcaataaggtgcgaccagtccatttatgtaccgtccttatcagcggaggcgtcagtgcactagacgtgattttaggggccaccagatctgacttttagggcgctggtacactggatcctgatccaaggtcgagtgcatgcgagacatactctacgaacaaccaccaatatcgttatcatccggagtaaagtacggggcattcacaagactgtatcataaccctggtagacttctgaaattcggcagcgtatttattaatatcatgattacgttgaacgttttgctcctcattcgggcacttctcggcttcaagttgcacaaggtctacactacaggctgcgaactacctacaggcgtgatcgtactaccccttctttctcgaagcccttcagcttttccacccttgccggagtgatctcgaaggcttcggggaggtttgtgtcagcccaggatgacccggccatcagcttgacgagtccaggtgccgcagtgaatattcgtgccattccgctgcagtgcaagtatattagtttgctttctggtgccgttctagcaaagggcgaaggacatttgatagaacttactgcccgttatggccggcacagacccattgacctggaagtccagggagttgccccacgaaaggtaggccgtcagagctctgattcttcttgttagtccgtccccaatgaccctacatgagaaagcaaagaatacgtgccattgcaatgattccgctccattccctcctgtaatactctgtcaccaccccgggccaccctgtaagctgagcgtctgtaaagtctttcacagcctctgtcacggacgggaagccggcaatgttgtcgtcagtggccctctctgggttattctcaagccacctgtagaattcagcctgcccaggattggagcccccgaaaagcacaggaccgtgggtgggaattcttgggttgattgtgatcagacatccacctggcaacaggataccgtacgagttttgaagggccttggacccgatgaagcttacaggtggagcgatcaagttacacatgtgaggtgtgggtttgatcagaccacgcaaggacggctcaagggcaggactgtaagcgttggtcgcgtgaacaacctgggcgcactcgatatcgccgcgcgcagttttgactgtccactttcccaattgtttgttggactcgacaacttgtgtgactgtggtgcgtgtctggagatttacacccttctttagattctcgctcataacatgggcagccagcttccagggatgtactgtcgatgcaggccaagcatagcatgcttttgcaccgttaatccgagatacctgcaccgttgtaagcaattcaaagttaaatcgtaaaggtgggtattaatttacctctcttgccttcaccgggtcatttgtgactttgatgtgatcaaaattgccccctgctgctttgtaacgctcaaagatctctttagcatcatctgccgactcccaggtgactggtacatctagagtatcgccgacccaaagctcgcagtcaacgttgttggaacgaacataatcaactacacttgaccatgtctcctgttcattttgaaggatctagatcatatgattagacattcttgtagcaagcaaaatctgtcccaaaccaaccttcaaagcctgctctgttccaaagtcatcctcgtactccttgaaaccgcgccactggtcaggtttgcagtgccctgcattcctgcccgtggcgccagagcagaactctcgggcctcgagcacaacaattttcctctcgggccatgtctctgcgcaatgtttcgctactgtcgttcccgtcaactattatatttatgtcagtggctgctaaacttggtattatccctcaaagttgaaacttacgccggaaccaatgattactatgtccgctgctgcgggcagtcccggagtggtgcggtagttcatcagatggtggccctgcatgtcttgaagccatgttgacagagggcgactgttttttggaaagctgtagaatccaggtcccatggtctatgaaagtaagagataatctaaaattttgttgtacacgcttgcgttatcgatatccaggaatttgagtttgctttcaggaacgacgcccggttttaagatcaggcaatgacgagatagagataatggcagtgaaaggtgaaagcatccgatctcggctactccaagacttccgattggcggaaactaccactttttctagtttctagattatcttccctcgtcactgcttacctaggtagaattcaagtccagagtatgaaggtggttctcaagccgaacgacacatggataatacatagataacggtcaagtctagcccatgattggctgcggtaatgtcttaccggaaccttccgccaatgagaaatggcttcggctcaagtggggccggcctctcttttgcttttgagaggctcgagtcagagatacacattaatataaacaggctttttccccagtttccacgtcgtcttcataatgggtcgtcctgagcaaaatcacatgtaagctatcttcttactctattgaaattgtcaccatgtcctcgccgcatgtcgaaaacggtagcaatcagctgtggccgcccgggacagttcgcctcgaggccaacaaagacagcaaaaccctcatcttacagcctcagccgaccgatgacccaaatgacccactcaactggccccaatggcgtaaatacttgaacatgggcctcgtctgcttctacgtcgccatggtcgccgagttcatcaacgccccgactcccacatggggcccaatgaataaagagcttggttacagtttcgagatactgaatgatagttatgctgctggctgtgcagctttaggtgttggatcgttgcttctgattcccttcgccctaaaattcggtcgccggcccatctacctcttcagcaccataattcagtttggcttaagcatctggtcggctaagatgcagacagttgccgatctgatgctcatcaacgtcatccagtgtcttttcagcagtctggcagagtcaattgttcagatgactatcgccgatgtcttctttatccacgagcgtggcagaatgaactcgctgtacgtgtgggtttggcttctctctagctacatgggcatgcttattgcaggcttcgtcgccaaaggattgggttggcgatgggtttggtggctgaacgttatcatctttggtattactattttccttgtcgcctttgcctacgaggagaccaagtattgtccacctcccgaggctactgtaccaggacggctacctgctgctgatgcgcataagtcaggcgatgccgaggccattgctgaaaacaaactgaaacgggaccactctgcgccaggagatactgatattgtatcaattccagcagctgaagtttcgccagctcagggtgttacatcaatcaccctcaaccctaacatccccaaaaagacatacttgcaaaagttagcacttacaactaccacgccaacttcaggccattcggatgattccttccttcgccacatgtatcaacccctcattcttttgaccacgatacctgccatcgcatacacggcacttgtatatggtgtcttggtgggattgggagatgtcatgtctgccctcatctcaaactacctgacattgccgccctataactttacatcagaccaagttgggctcatgagtcttcccagagtgatcggcgtcacaattggtgccgtcatcgtcggtccgttgagtgactggtggattgtctattactcgcgtcggcgtgatggtatctacgatccggagtctcgcctctggtgcatcgctcctttcatcctttttgttcctgttggtgcgcttctctttggatttggccttaacaaccatatgccatggcccgttgtcgcggttgggctggttctctataatattggagttacgccaattaacagcttgtcaatcacctacttgaccgactcgtacactgatgtaagtctacccttctgggtgttgccgatagttttggatataatttctaacgctagaataggtaattggcgatgcgttggtgggtgtcacactggtacgcaacacgttcagtactgccttcatttttgcgctcgagccatggatcgaccggatcgggattaaatatgttcttgttacaatcctgctaatcgcatgtctcatcttggcggggttcggagtcttcattcggtttggaaaggagttccgagggcgcactgcttcacgatatcagtactatgcagctcgtcagtacaagaccagggcctgatattaatgatctggataccactttaccgtaccatattcaaatccagaatttcttactatactcgacagctaataaatgtagcttgatgggttaaactttgcaggccctcgtccttcaagtacggttattagcctgacgcatcaagttaagccccagtggtgggtgggagcggacctcatttagtaaaggcttcttaatacgcctaaaattcggtagaaatatgcatgcttatcgtctgactagtaagggagtttattacctatgtactacccgtacatataaccagccagtaaactcacacgttcggtcataccaatggccgctgcgccttcaaaacttgaattatgcagaaattgcatcagcagctggcgaatgagaacattccacgtatataaacaaatactggccccctcctgcggtagggatatcttggatttaatacttggaaaatatcctttccttttctatactcccctaacgatcatcaaacatttcaaaacttcagtactaagtgacattacaaggatctttcaaaatgctctggtcatgcgtaagtatccctgagtgtctactagagtttctaaatgtattaacttgtgtacgatacagtcggagtgtgggcagaacgacctcagcatagcagtggacaggtcgtgttcaatttgtagccatattcgttgttgtaattgctatacatatacatatagcaacaaatcatcagtagcagacttcacagcaaggccgaagcaccgaagtacatctagccgcaaaagctcgaaacgccattcgcaattacgccaaccaaatgcctctgaaggccatcacatcgctggcaatgaagtgaatactttgaatctaggatcagcttctcaaatccctcctataccttcccaagaccctccagtctactcagataccgttcagtgctatcgcactgatgaattctcttcgaaagatttgcgggatcagcctcacgaaatgaatgatgtggacgaatttgggcgctcgccgcgccattatgccatacatcacaactccccggaaatgatcgcaagtctactaagttatggggccaacacccacgaggttgaccatgatggccatagcccacttttttatgctgttcataggggcgacgaagagtgtataagagagattttggtgcgttcgaaaacccgagatccctcgcatgaactggagtttagcaaccaaatgattttccatccagggaagaagttagtggttgaagttcggtgggagctccctcgcttattggaagacttgaggaacgaggatccggacagggacttcatggaatcaatgctcgatctcgttacaattatcggatcaggcgaaaactatgactgttgcacttgcggagaatacctttccaaaacttggcctgagtttgggacatcgctgttcaggcttttcatagaacgcatgctgagtccggaaggtgtacgagagaaccttaccttatcggtggagttggaagaaatagatgtgtggctggcgacaggagacagcctcatattgttgcttcccacaacctgtcggaaaaaatccgacatctgcaaggcgataagctggatatgcgctgccactcggccaaatctaaatcgcctcgcacggcctgaaaacaagagtttgcaactatcaaaggctccaaaaggcatttggattggcgaagagtcttcggagcttgctgtgatttcattcacccttgagccactagaagactttcgagtcgatccgacgtctctaaacgcacggtgttgggcaagtctcttcaacaccgcgattgttgtcgaatatcccataaacagatcctgggggcgcggtttagaaatgtcgttcgacatgatgattcatctagcggcagttgagaattatttttttttggatgatggaatcatccttctcggctatttcactgcgctggtgcctatagagcaacaacacggcggcaggggcatgcatggcatcttgagttcgcagatggctcggacgattgcttgcatgtctcaaacctaacttcgataaaaggagaatggtttaaaacaggcgagaagtcattattgcagcagttcaaatgcttcctcggctggtcggaattggcaaatattgcacttggtacgcgggctttctgtgaacaaaacaagttcagagctagttacaatactttagaacgccgccaagtagctcgcgtagagggtttcgaggctggggtccaggctggcttcactctcggcccaatcctcaacctggcgccaaaggcaacacgttcgtgggttttccactccacagtacagcatttcggtgcaccttcaagctatatgcaagctattaatctaagccgagggaaagttgcgcttgtactagactcgaaaacaaagcaagcgtggcttgtccctttcttgagcctggcgctccacctatgccagcgctactggcaagagattggggatatgaaatcgtctccaataccatttgctaatcttcaaagcgatggagccgaggcagccttctccgctctccatagcaacggagacctaatcgtctccggcataaaggaagatggggaaactcttaggtctctatttttacgtataaatagcaacctgctgcaaacacaacgcaccagagcgccttcaaagcaagggcgcattttggcctcagagcttcttgacattgtcattgaaccaagcaggggcagtcccttgaagagggttgatgttcctgaaaggacaagagcatggctccccctggtcgagaaagtcgactgtgttggtgtctgcgcggatttaggtctcgcaatacaaccagtgaaaccacaaggccgcaactgtggctgcttcgctctcccagaagacaaattctatctagcagcacacatgtggtgtttagaccaactcgcccagaaatcaggcagcgggttcgaccagatcgcgcaaggaaagtgcaggcttggcgaaggcctcatttggaacacagaatgcctccagtgggcgaattgcacggtgaacaacaggcatgtacccgtctggagtgagagccgcgaaaccagtatcctgcagcaagtgtccggaaatcgtaacgacagcgacttgcgatgtttacagggcactatatgcaatggttcgatgaagaaagagggagtagttgtattcggagatgaagagcaacccaagcgcttagaaaaaatcaaggcactggctgcgaaactgaatacatggctagatatctcaggcagcgagaggctgttcgatgcttagaagcagtcgatagtttcgtaaaccagcttgatagaatgagaactctagttcacagatgtaaacagccaaaagaaacagccaaaaagccaattcctgccaccttaatttgatgttgcattttactcatgtttaattagattgccaagacttgtggtctgagtttgctgacacgtccaacctcaatcttccccttactttagcatcgcccctaactcgagacgcgttgacgagcaccccaagagtcaccgcgatactttgattgaaatgatggcgggcgttcggtgcatgctgaggcttagcgggacatttctactctcaatcgcgccaatcgccctggcagacgtgactatctacgatgagctcgacaagctgacgccaaatttcacgcgcgtcatcaatacgcctggctacaacgttaccgaggaattccctgggagtcaacttgactgggagctctcactccgcctctattccgacgtgcctggccaggttgacggcgaggatgatagatacatttccgcaacccggtttttctgggaccctcctagtagcgttcctagagggagcgacgggagtgtggatgcagattcacagttctattattgcatcagcccattgaagtatgacgaacccgaggtcaaggatagtgacgaggtagaccccagatgcaacggtgtggtttcagacgcgtgccttcaagatctgcagaagatgaccagcacccagtcctggtgcgctatcctggattggcccgattcatgtatggatcattctaaggataactcgcagttacatagtaagtcaattcctagcttaaagctggacctcaggtgcttttagaaatcttcaaaaatgtaggcctaactttacgcctagtgtacggtcgcgtcaatatcacagaaactccaaactcatttgtcgcattcccaagcaatcgggatgggcataagaaaggagatacggaagacttccgcgacgcgttaaagaccgtatggattgtcatgacgggctttggagaagccactcttggtgggaagttggcagaaacctccgaagtgaaccttacaagcggaatatcttgcattcgcgctctgagtgccaagggagcatcttcggtgggcaacagcaagacgagttctatccctgcggtatcttctctaatagcaggtcttcttgttactgcagcctggcttctttcgtcggagtaattagaacttgtttcccaaagactaagcaccaaccttgctggtctgactacaataggacacctttacgctcggagcatcattgtaggtccatgaaagttgacagagatagcgttctgttgagccagatcatctggcttactttttcattttgtctgatctgaaatttgatagacgccagcctgaggctagtgttatacctagttcagcgacctctattctataacctgaatataacgttgtataatatactgattgatctagtcgcggtaataatatgagctctccctactactgctccgtcttctgtcgttggccttgtccttcttcatgtcgtcaaacagcgctactgctgcaaccgtcgctaatgcgattggggcgttatcgatcaacacctgagccaccttatcaaataacaaagagattcgtgaccatttcttggaaggtgggaccctcagcagcttgggaggtgccttaagccatcgctttggatcccaagcttccctctgacgccggggatcaccccatccttggtcaactatgttgtcgagaaggtaaacggcccagtcttgacaatttctcgacagaacactatacaggccgccactgtctcctttgccgaatttatctacatgtttgttgaaagctcgcttgcttttagccaaagctttgtgccattctcgagagtaatgatggtccaagaactcctccaacactatctgagctgcgaggttgtgagatgagaaataggtttgtgttaggctgacttttactgaccggtagaaaggaactcctcgaggctgaagtagaggatatactctttgtatcgcttgaccttgagaatctcgtcctcgtacattttgcgtcgccagcgccgtgtcggagtgcaccacacggtctgtaccgccagctctttcatgctctcatccttgaagtccatgctgcatactcgatagttgggctatataactcatcttattagtctgccatacggatgagagtatggctcaggttttcgtacctcgggtgcatccagctcacatagataaaccccccaatgcgcgcacagctcattcagtggatcgtctttcaacgccacgtatttcattggtctgaaaggcttgtatgcaatgccgaccttccaagcctttcgctgctgaggcgaactaacttggatgccgtccttagacaagatcattttacttcccgacctgctcgtgctgatatggaaatcggggtcacgatccacatcacgccagccaggccctgcgagactgttagtaatagtgatgcttgtcaactctctagcccgatctctagtcgctcccgagcggctttttgaatgcgcatcggatcgcctattctgaccgcggccggtgagatccctccaccgatcaggatgtgagtgttcgccgagagcgatcgatgattcagagcctgggcttgacatgcacacaggccagtggttcgtctgatgtgcactctcctcactatattcggaatctctcgggtttctcagactccaatcggggtatctcaggttgtcatccctgtctgtagggcagaattcggatgttgactcattttggcccaatgcaatccgtgagctaaacctagacgaggactcgtgaagagccaatgcctggtctgatcgtactttggggtgatttggcgagtggtatgggtatggtacaatatgacgatatttgaggccgggcctctcgttgtcttccacttcatcgggaggatatgtctgatgtaaccaattgtatatcgcctcagtgtggacagagtcacgtggagggtccgactctcccagacgagttccccccatcgcttccacgtctccaaagtgataataatagattctaataggattaggtgctgccgagtaaaaatgatgtaagtatttttgccacagaaacactagaggaacgatggagtctatatcaacgacactctcttttcatcgccaccatgggatgaaaccacaatgtgcattttccaaatatatcctgccccaatcttgtgagcgctgaaagcctgtggcagttcacactatagtgacggaccaaaacctcccccagccacccttcctctattcctattgatcctataggtcagatattgttgggaatcttataggtcagacattcttaggtcgtatccattgctcctccgccaataagtgtgccagcgtgccgacccgcctgcaggctatatgctctgcctaaaaattagggacacggcagtccgaattggggattgatctgtctattgcttgccggctgaggcactgctcctggctaggtcttaccggccagtgtcctggttgtaaccttaagtaggtagcttctgccggtggacatacttgaccgacagtcatacgatgcctctgccatcttggtgataacgtgactgactcctgcagctttagctttttccgcagcaggacccgctcatgagtgcgcccaagcgaggtatctcacaaatgtgatctatctctagctcggtcggactctggcttttcgttggcctgccggtcctcccctgcaacattgagtggctcgtatggttccattgcatgtcgtccaggctcggcggcttcgtgtacatgtagcatggcgcagctgagggactttgggagattgctttaggcctaattctggtcagactcgggatgcgagcagcagaggagaagcatgcgaggagcatgcggtgtgagctctagggttcaatttccactgggtttcttcaacttacgcatcttcgaaagtccatttacaggcagacggcaaaatgctcgataccttgaggcgagcaccaggtgtgcttttccgcgtgctgatgcccatccattggattagctgggaggtcagcgtcgtgccattcaaggcgattggaaatgcggacagcgagcagaagcgtaacagcttgatcgaggcatgggtgaaaacaatgagtcatcagctttcgaatgtcatggttactgtatggcgcattgactcccgagatccatgtctagaaataatactcacgagttccagggcaccatcttgtctggtgtaattgttggcagcttcacatggacaatcttcgaccaaatgattcctactgccatgactataatccggattctatggtactcaagcttgattctctccatgaccgctgtaggtgtggccttacaccaaagcgttttcctagcaagaatggtcaacgtccctgatttccactctgtaatggtcgacattctttgcttcgaagctcagatggggcaaatgaaacctcgccgagagcaagctttcatttggcttctcgctattgggctcctggagtggagccttggcttatggtttgggggctttgtggtgttcctatggaagttgacgaagatcggccagcaagaccaaacattttccgacagaatggtaggtagtctgtggaacctagtattgattcttgctgacaacttggctaggttgctgggttcgtgggtttagccgtgttcatgtccgtatttatatattttttcagtattatcggattatggcgaggagctctcaagtcaaggcataccatgaaaattaaataaaacacattaagcaacgtgagatttgggttctttctgtttatgttatcaaggctagtagtgcgcaaatgtctcgatggatgtagttggccctggttcactttcatctacacatgtctgcttcatagaccgtgcagaaaaaaaagaaaagcagaaaatgggataaagtgattgtttgatatgattcagcaagtcgtggcgcacaatgtcaaattgggttcttgttccaaggtatagatattgacctctctctaagtaagagaaagccatagtaagtgaacaagcgtacagccgacactcaaacggggaatagaagctcgccacgctgataaactataaaggaagtgtaacaagttatggaaattgataataagataattaataatattaaatgtagagggagaagggagttatctggctctgggtatagggtatcctgttcaacatagcccaccctctggcatttaattaaactgagcatcacgctcagacgctaaacgcgcccctggtcaaaagacgcgttcggaatgtttacatcatgaaaccattcgagtagttctcaatttccggctaggctatggaacaaagaacagctaacccctagagtttgcaaaactcaacaccggcccttcagtatgatgtcctctaaagctactgccggagtaaaacgccgggctgcgtgggacgagccgcgcaggctccctccgaaaatgcgagtcctcgagcctcaagtcgccgttaatcagttcgcgatgtctcaaccctcatctccccagactgctcccatcatcatgcctcccactcccggttcatcacccttgcagccggcttcttgggactttgctaatgagagcgcgggagacctgggtgatacataccttcggagggcgctctctaaatggacccaagaggaggctgttgagctcctggtgtctcttgcaaggaaaaacatgcgggtaagacttacgatcgaaaacgagaaccgcaggatggccaggacgaggaagaaaggttgggataaatctcgggcattgaattttgacgatattcttaagcgtgtggaacaagacctgtacgaggaaaagccccgatcctgcagttatgagagagcgttggatgaagccatggacgttgcagcccgcatcgcacttattttccgccggttttcagaacacctctcgaaagacgacccctcggacgtcaagtgtggtaccatggtgacggtggcgaccatctgggatctcgtgattttcgcaccatcctccgaggcacgcaagcaatgtctcgcgtcgagtttggagtgggagggggctacgctgagcttatggaaacggatgagcgaactggaaaagaaatccttcgcttcacatgccggagtggtgaaaactcttatcaagacggccatggaatgggagaaacatggcaaaaggcaggacatgttcaatcgctggttacgaaaaatgaagaaggcatcggatggaacgctgagtgccgaatatgcggaatgggatacacgaacacgtccttcgacgccccagaaccaactagtcgaattcggaccaagttcgccccctcttgcgaacttaaccttggagtagttgtcacagccatcgaaattgttgtcacaaccctatctggccaccatgctgggactacccgctaggtaagcccagcataagacatgcctgctggcacagagtgcttgagagtattggtgccttcagtttcctaggaattgcctggccgcttgttaagagtgtggataagaaagtcaactctggacgacgactcctgcagtatcttattcaaaggcttactcttggcgctcaatattcaaatgcgagatcctgatatggaagagttacaatctccaggcgccaccgacagcttcaataaggatctctttgtctacccatgtagttctgggtgtcgatgaatgagaccgctctgggagaagataacgatgctggggcttaaattcaccaagtacggtgtctaagctttattaccgatggcacgcaagaaagcactatcctgcttcaagaaagtgcctttcctgacctaagccgaaagccgaatggggctcaagtaccccccaatgttatacctggtatgcttgagggttaaatcgagtgggtgggaagaaaaactagcatcttgtagttagtggatgatgctaaagatcgaaaacatggtagaggggacatttgcaacacaagtatgccttctatcgctagagtatatagctgctgatgtatttgccattgtcagaaaatatcataatataacgtggtccgaggctgtcaaaaatagttgattggggttggtggtagagaatcgtaatgacatacatccgttactccacagcttcgagaacagcaatggcgatatactatataatatactaggaagataagagcttgctctgtgaggctgatgcatcccattcatttcctcttcggcttaatcccggtttctactccgccgagttcgcctcccgaagccctcatcataccgagactcggcggagtaatggttagccttcggccccttcctagtgaagttgctacatttcccgggttcaagagcagggtactttgagaaacctccaattacagtcttttatttgcccgaggttatctgtctttcaccttctatggactcgaaatcagaatgacgctcgcttctagcccagacttggccccgctacccacctcctgacccgggattgatggacccagtatgttgtcatttgacactcttttacatcgatattcgccctggtacatgagacataaactaaatcaaagttatccccgatgagttccacggtgattgcggaattatgacttaacccctgagaatcttaactagaaaggcggcaaataaaaggacctaggaaccgtccgtttagttgaacgttccccgaagttcctcatatgtctacctccctgaacatgaagccgatccaagtctacaacgggccgcctggcacaggaccaaatccctggaaagtcataatcatcctcatcgagctcgggctcccctggaaaactctctggatcccatacaaagagatcaagcaggccccatacacggacctcaaccccaatggccgtctgcctgtaatgattgatcccaacaccggggtcaccctgttcgaatctggcgcgattattcaatatttaatttctctttatgatacgaaatgcatcattagctatggtgacgacaaagctgaggagaaatggttactcaacagctggctcatgttccagatgagtggccagggtcccatgctgggccagaagatgtggttcactcacttccaccagaagagaaatgtcacgacagccattgatcgctacgccaacgaggcgaaaagaattgtcggcgtcattgattcacatctcagcaagcagcggcaagcacgtaaaatccccgacgctgaacctgtctggcttgtgggagataaatgcacctacgcggacctgtcgttcgtgccctgggatatcctgctgctatcgagcttgtttcccgatggagattttgatcctgaagagtttccggagttctacaagtggcacaagaacgcaattgaccgtccagcggtacgtgaagcactccggcaaaaggagcatgccaacgcgactatggagaataccgctgctgctgtgctgcctgaacgtgaagattgagagctgcagccgctcgtatggatcccatagattttactcttcagaaggaataaagcttatttatactacctactctttgaatgtctaatgcttggatacgaaagaacaaggagtagtatcacccaaccaaatgtgagcaggagtgctcaagtggtgttcaacagagggtcaaatgtcgtttttgctgcattgacggcatggagctacaattaaatgttgactgaaacccgtgtagttgactgatgaacccttggatgggacaagggaaattgtcaagatgcctatctactttgttggactgcccaaggcggacatacatgatagaaaacagcgtgcacgatgcaagctataaagtctgcggccctaaataaaagatcagcatattccatttcaaagcttagagttagattgaggcaaatcaatttaaacataatacacataccagtgtatccaatggaatccagggaaagagcttccaatatatgagccaaagcaccgagccggattcatactggcccctccgtagccatatcgtgtgaaccctgttccaaacgaaaggctaccaagtgcaatgcctactaggaatgggccaagggtaggtcctatgatgttcctctgccggggatcgagaccgacgccaaaggcgaaaaaaagtaagatagtgcacgccatcaactctatcgtaaatgcgtcccagaccggcacaatatcagtgtagagccagcaccctccaaccttgaagtctctggtaccatagcttgcgcgagcgagcaagccccccagcgccgcgccgccaacctggaaggaaacgtacagcaccgcccgaggcagtgaacacaggcgtgcaaagagtgttgcaatcgtgattgttgggttcagatgggcccctgacacagcaccgaagcagaaggtaaatatggtgatgtagaagaagttgagtatgccaccaacaagaggtccaatgaatgatgcgttgtcgaaattaccccaacgctgtgtaggcgctgccgggatgatggctggggatacattggcatagatagttagccagacaagcatcaaggatcctgcaaggcaagtcagcctaagactatcaaagagtgatatcgttctccttaccgacgccctccattaatgctgacttccataggctgaccgtcagaaaaggcttggggttgaaaatgtcccttagactcatcaaaggtgccgcatcaggaaccttctccaggaaagcctcattggagggctcacgggacaaggcaactccatttcctccaagcctgccaatgaacggaggtatattgatctcaaaatttcgagcgctttccattcctgataccgctgatgctgccaggccttccggatcgggtccattgggatgaggcgctcggtgcctttgattcccagccatgttgaagtccggtggataagatgttgaacaaattgatttgtcgtgccttgttttcaatgatgaggaggatagtacactgtgccatcaccgcctatggtgtctaggttggaagattgctgatgacaaatgaaagacgtctgtataagatcatgctttccgaaataaatggaaatagagtttcccagcaaagggctgcaattagtacttcagaggcgggacggacggagtctcggcacacaccgccacgatcggcacactgtaggtatcaaattatgtctttgtaacttacctagtctctgctcggcttctgaaaatggccgggctacccgtttttgttcagccgcttcaaagaggtactttgacaggcacatctctaggttgtgggtcattaataagcatcgtcaaagcttacgagtgattataattataagtaagatcttataattaccgagccttttagttgagtaattttaaaagtttgctttatactacttagccgattacacccattgccatccaagcacctgtttcgactctatttacattcctgctttgtttatatgctgtcggaactatcagttagctaccatggcaacgtcccccatcccctaagcgtagatattacgtttctttttatcaaatttcagctagttatttgagatgccttttctatctgaatcatgaaatttcttcgggagtcataagggcaaagtatgctagctagtgtcgtccgtccttggatacatcgtgcagtcggcccataaccctccatcattcacaagcttagacacagggtgtggaggctcccccaagacccagttatagtaattttctgggttgcaatcgggccacgccatggcagaaatgttagggttcgttacatagtcgagatcaacagactcccagcttaaaagtccaaggccatcgtcatccggagttgacctagggagtgggtggtatgtcgatgcccttgtactttcatcactaccatcttgattctgagagtcaaaggctcttgctgagcgagccctcttcaatagcctacccaggggcttgtagaggccacagctgtgtacgtcgaagtctgacagtggacagctgtcaacatctccctgacgagaagaagaagaagaagaatggatctgatggccaagtcgaagagcgctattgactgcatgccatgctctgtccactggttcgccggaggtacgctcacatagttccaagagtagaaaggtcaaagcgtaccactggaaatacgtctcacatagccatctccaacgacgtgtgctttcctcttcgttcaaacgcacccagttttcgataactgcggttgactcagcaaataggcggtcttttatatcggaggagaagccggcagaactacccctttttaggaaggggtggtacgcaacaagccgcattttggtgaatactatggcgcagatagtggatgtgaaccaggcaaggggattcgagagatctaggttcttcaggtatagttcatggagtcggtgctcgataccggagattgcatctgtcttatccttgagacactgtgctgcagacggcctcccattcttacccatgggacccgatgacatatcctgcagattttggaaaacttgtactgactcaaaccgaacgacgctgaaggtcatttctgtaaggccgacccgaggctgtgggagatgttccatatttgcgtaaaggtctgagtcgttgacattgagcggtagctgggtatcaacctttccgaaaggaatcatggtatcatacccagtgtcctcggacgcccgcgaatcgagaacgcatatgctccaccacagtctcctccgcatttccaccatgaagggaggcattttgaagtgagttccatcacggtgaatgccagcattatttgcgagtcgcaccaagagcgacgtgagggttgacatggcacgtgcgctgctgtgaatcctcagcccggtgagataaatggctagggcctgcaaggtaataatctcgtcggtctcaagaaggcctgcctggaccaaggcttggtcggtacccaacctgaacacgtgggcaagtgtggccttttcgcctcctaggagttgcaggcattcgctgggcgatagacttacgacaacagcatagtaaacggccatcattaaggcttcaagtcctctagggatgtgaccaagttgatgtgacgcccgaaggaggagtggctccactgtaggtacgtgcagaaccttgatgagtatatcgcagttttgcttgaagagcccccagtaagttggtatctttcctgggggtgggtgtatctgcgagaggttctggaacggagaactaaaacctagcatacgagcatgggtgcccatgcaactgtctggtattatgtctgggtaccattgttctgctttctcgggaggactctgtaagaggctcttgaggtcttgtaccttgacattggcgtcagtaaggggcaactggtaagtaacatgagtcatgaacatacctcatcgtctaggctggcccaagaactaccaataatgtatctactcctcccattttccagagccaatctcccgagatccttacccaaaccgtcaatatcgtcgacagatgaggccggatcagactgcgatgtagagtctgtgtcatcccatgtcggactgcgtggaggagactcatcagaagctagccgctgggcaagttcagggccaatatgtttctgcattcgattgatggtaccttcaagtcgtcgcagtctcttcataatgacaagggacggcggctgccgggctgattggcgtctgggaacatagaggcattcggtccctagcctctggcagtttgagcaaggggaggtcctgtcacactttttcttctttccccggcatggtaggcatgaatatggattcagtatgggtagtgttggaggtgacaatgaaggtggctgaacagggtcacctggtttcgaactggtgtctggttcttggaacatgatgcccacaacttggaacggttgtctaggacaagtccgcgtactctcgagaagcggtgtttgtcggacaccgctttcttggcaacttcaacgtttcttgagatggggttggagtcgacaaaatatcacatggtggattaccagaccagtgagtgtccttgccacccacatattagtgctgacaccggtattgccgagcggggtcttggcaaagaccgcccctactggaacctaagccaatcaacttttccctaagtcttgtccaaattccaaatatgctccttagtgggcggggcaagtggtttggaggttgtcgcggcggcttctaatcttttcagtcaagccctgaactgaaatctaggactcgcccgtgaatgctaggcggtttacattaatttatgggaaagaggatacctgcaagagtggcccaagctaaatttcattgtatcataaggctggccgacatcaccgctctgttcgccatggcgtattaaagctacaaggtgatcactaataccacatgaacctattttgatagctacaagttgcggcaggccagaccaccccccttcttatacacttacattctgaaaccagcgagtacctgtcataatggcttcaaagggtggcgctgacaagcttctgcacctggtacgactcaggcgcacatactacacactgaacaagcatttgactattccccggcctcgtgtcgagcatatagtcaaagagtcgcttctccatgtgccaagcagcttcaattcgcagtcgactcgagttgtggttttgtttggaacagaccatgccaagttgtgggacatagtaacggatgttcttaagaaaaaggttgccgaagcgaaatgggaaccgacaagtcgcaagatggccatgtttaagagagctgccggaactgtaagatcgagactttgcttaacattcttggatgtccgagttgctactgacagtgtgaaatatcagatcatgttctttgaggaccagacaatcgtgaacgaacgcattgcccgattcccgtcgtatgcccagcattttggcacatgggcaacgcagtcagatgccatgttgcagtacaccatctggcttgggctcgaggcagaagggctgggcgtcaatctacagcattacaatccaatcatagatgatagagtggctgatgagtggaatattcctgcaagttggagattgaatgcccagatggtctttggtggctatgaagacaccccagccgaaaagggctttaggccactcgaagagagatacaaagtgttccaaggcgatgtggagtaatccatgggcatatgtaacggagaggttctgagagctaccaattgagtatagaaactagcttggttgtttcataggtagaacttgttttggctgtggtatagacctatacacaagtataattgttaaatagcttattaccaaagcttatttgtgccatctctagaatatgacattagtaagtttgaaactggctacttgttaaattacttaaggttttaactaagaggttgggaaaggtgtcaacctgattgaacagaccaaaagatcaaccatttcaggcacaacatgtctgaactgccttcgacatcagtgtattaggcgcctcgggccacaccaacagtggccacagtagctctctcattttataggggctcaagccccacaacgttgcaggacgacattgttcttgcatcggtcgtccttcttgaatcacgcggggtttaatgagaggtgagtgaactttgcgaggtgcatgtaatgtaaccgcgagggtcgaaacaactaataacccgaaatttattcaagtacttttcactttcttaactttatacatacatgatattctaatatataatacccaatcacactctaatataaagtgttatcaattacttatagcgatctgtccatctcgttccaaaagtcacatctcgttacttgagcctctgtcataggctccattcttagttctcccagccttaccaaaagctttgagcgggcgtttccgcctccccagtgttcccagataggtgcactaggatccttatgcgtattcggggacaaagtaagcacaaatgatatccaatagttcataactatagaaaccaaaggggcattataggtcgagaagctggctggcggctggtatcttttcgggatcttagtaccagaaggcccaaaaatgagtccttcttcgtaaccgtgaggacagcccagtcccatggcgacgtattcttcatcatatacattcatatggtaggaccatagcttaacagacttaggaagatttagctcctgactgccatcaaacttccccgcggcgtttagaatggctaaggctggacatgtaaaggtagattcaccatacgcttgctcagcggatgggaaccattcggcgtgctgtggaactggatttgtccgcgggtcgtactcggtgatctcggtgatctttgttttggataatcgaggatggttactgcctatgaagagacgtacttcttcctcggttgacgcatttgcagtaaagtaagctccctctgcaatatacatgttagccagacgcacgagatggactttgggtttcattattacgactaaccattttcgttattgccgataatcattgggactttaatgaattctcctctcttatacatgtccagaggcttgtccggaatgaggtctccatcagtgcaaggtgtccacggccagaccggcagcggttgcgatggaccgccgggaaacggagtcgcgacattacctttctgaagctctttggttgtcttctcgcgcaaacaccgcatctgtagcctagcattaccttcactacacccgacggtctgaatgaaacgttcgtactgccactccagttctgatgcgagcggctgtgtgggcatgaaggttgactccattatagcaccagtgaagagtcgagtattggcaggattcaggaggtgaagagctacagaaccggcgcccgcggagctaccgtgaatgactacatggtctgggttaccaccaaactatttcatcctcggttagtagtcgacatcgcaaggacgatatactacatacctggtgaatgtgatcttgaacccatagcagaaccgctaattgatctaagaggccgacattcaagtcgccaaatttctccatgggtttgccagctaagaatccgtaaacgccgacgcgccagttgaaattaacaagaacaatgttattgttggacttttcaacgacttccgaaccgttgtagttggggctgtagttgagattaaagcctttgaatcaattagggaaagtaaaatgatgaaaacagtctgtacacacctccaccttggatgaacacccagaatgggagcttggattcacgtgttgcgtttgatgggcgccaaatgttgacgaaaaggcaatcttctgagacgccaacatctaccgtctcgttcgtcccaatgcagtaatctccaaactagtcatcaatgcttgtatcagcaaagtgattgccagtaaatcttggtggacatatgtcacaactatactgaagtagctcgttgtacgtctggttgttgtttaggtggctgtggagcacgaaatctgagatctcctaggggggcttcggcataacgtattccaatgaattcatcaacttcatttgagagtcttgttccaacatatgttgtatgatctagctccacctttgcggaaaaggtgttggctgcgtgacatccggagcttatcacggcggcgatggctatagttggccaaatcatgatgtcaccagaatgatccatatattaaacgtaaatgaaggtagccttctcagtagtgtattgtgctggagattgccttttatgttcctctatagaacacctgaaaactaggttactacactggtacctcctcgccttgtcaacttttgtcgatcttttggctgagccaagtgggaccggtcggagtcttggcaaatccctcaaaagttgcgtgccaccaagcgacccaactgcaactcctccatgtaagccttcttcctcgtcagcagcgccttgaacacgattatcccccacatgggtgcagtggcgactgcgatcaaagcaatttgtaatatgtataagctgtttctaagcgtctgtgatgagtggattattcatacataagaatggaaaagatggcgttgacaagtgtatataccaaccgccactctgcaatcatattgcccaaacaaagctcctctcgacacctttaccatcagcctattttagtttaacaaccattgctcatcgcaccacctatttaccatgtcttaccacggccgtttaaccagagagaacgcagcgctcctcatcgtcgatcatcaagtcggtttgttcactggcgtccgagacatcgatactttgagtctcaagcacaacatcgttggcttaagcaaagccgcggcggccctgaaaattcctattgttgtcacaacaaccacagaaggactctggggccccatgatccctgagcttcaagaagcactgcccggtgttgaccgtatcgaacgaaccaccgtcaatgcctgggatgatcctcgagtggtggctgctgtggaggcgacaggaaggaagaacctgattatcacgggcatttcgacagatgtctgcctggcattgcccgccttgtcagcattggccgctggttataccacatatgccgctattgatgcgtctggtgccttcaccaaacaacaagcggatgcgggagttatgaggatggtgcaggccggcgtagtccctgtctgttactccaacgttgttgagatacttgcggataatgcagctgctgaagtcaatgctgtctacgctgcattggacatgccatttgcaaggcttgtgggtgatctcaatcaatacttctcaaataagaactgaagtcaccgacattttgcctgagctataaacctcttcgtaacgagggtttctaacatgttgttgtggtccatatttgtattcggagttttaaccatagcaatagctcaagaatttaaacgacaagatgacactccccattgatcccacacaagatgcttgggaataactgtgtaccgtcgatatcgttgtaatcatgacttaaactgcctgccataagataggaagtgcacggtagagatagaatattaccgtaggatcttaagacctcgtaggctggggctcggcaaggagctctttagcacggacacccgccactagatgttgagagtcagacaacaaaagtgagtttctcgtcggatccaaatttcatatgtctgtaacgagcatggctccttgtgtagtatacactttccagccacaaacacatcggatcacctgagtcataccgtctcaacagggagtatacgagaaggaattggctaagttcagagtcactttgcggaaggctacatacagtgcattagcaatcaaggcgtgtgaaaaggcaattttttcgaagtgaagcttgtcaagtaaagggagatgccccttgtgtcgacaacggatttttagacatctaaactctatctttgcaagctggtggctatgatcacattattcttgtcttaatgttgcagggtaactatcatctttacggcgtacagaaacaattgtctaagtaatttagctacatgctttcttaactctatgggatagactcctctgcaggcagcagaagagaccacgacgcaacagtcaataaacatattattgctgcttaagagattgactttaaccgtttgagcacgcttagcggaacacccagctaagaagcacagcttgcgccgtattggcgaaaagggaataaaggcggtgtttgccaagaccccgcctcaatacccatccagccatctcatcaggtagctgaaatgtaaagaaataaatccggggtaaggcactagctgctggcagatccaacctcttccatcatacgccaatgcacacactcagcagcccagaagctaaattctcaccaaagcaccccactgagacttttaacgtagcccactttgccagtgatggcatgcatcgcttactgtgcgtcgttgcaatttccaatgatggtttatgactgatatcatctaatatggaatccaagcctacatattataactacaatggagatactattccaccaagaatacacatatgaatttgtcaagcgaatcaacaaatggtttcagtaagttgtctgatagaagttgacctaaaattatagcatgatccttatacaattcgtggcgtaggtggaggaagccttcctggagatcagttccaaaaagattcaaagaaggggcacgatcgagagtaagttaccaaaacaaccgaacgtacagccggcgccaaggaatatatgccataattgggggcgctctaaaatattggaatcctccagcgggctgtgaaagacacagtctaggaaagttcagcggtcgatgcgttcataaggaaagacagcttattgcaagatgagttctggttgcatgcattgcattacctacgggctagattactagtcatataactaacaggaactaggcaatattttcattcaagattgtgttgaagcgctacgaaccttttggtttgagcatctgccgcagggtgccagccgttttgttgtcgcggccggacaccataaccggtggttcttccctgaaaaggaatctgactatgcctgcgtgtacgagattgatgaattcctattgatcaaaggtattcgctcacagacatcaggactcagttcggccctatactagaggctatacgtaattccggagttacctcagtgcatgaagttttgtccattgctcaacaccgcaaccccttagattggttaagcctcgttatcttgttggataaaatcacgcggaactcgtatcgtggtgacaaagcgtctatttgttttacctattttgatcccctggctcagcaattgtctctcgaggcgattaagcgaggcatccccgatacggcgccggaaattcgttgaggcatttcgcaccgaaattggttctatatgccattgatgcactcagaggacctgcctgcacaaataaaggctggacttgagtttgagcaaatgaaccaagacatgttaagcctggtggaggagacaggagttgcggatgaatatgagaagagggcaagggatgtcgtacaggcagaccccgaggcagcaaagaagatgggagagattgaccgggaatttgaggaaaatcatcttatgatcatagagaagtttggatggtatcctcataggaatcaggcgcttggtcgggagctgacgctggaagagatagaattccttcagaatggaggcgatacgttcggtagccaaggcggtgctatgcaaggtttccgtatctctacttaataagacaaattatgttagctagtgggtagatgcatagagtagttactcgggacacgagatctggtgcgatgtatcaacccacctctagtgcaagacattcaatgcttgacttttaatagggcaaaagctagaagggtgtcatataactcctcgcaatacacgcatcatgcaacaccgtcatgcccagttcctcggatggaataaaaggcgaaaacgactatgaatctgaaacggcctttaaattgtttcatacatcgccgtctccgagccatctctatgcgaaaaggattaggagccggcctaccccttaaagtccgtgtccgcgcccgtgtccgtgtccgtaggaaaagacggctcggcaaaggatcaaccacgcgtgatattaaattgtgttcttcccctatgtgagctaggtaatcacagtaaatgggaaaggctttgaagaatatgcctattgcacctaacttcttgaaataacatcgaatactacaccccgcaaaatgtccccgatcttcctcgcagcgataatcctttctatggccgccacaggagcgccgactgctgaaattggacattatgtgaaaatcttcgaacggcaaaactgtgtgggcagcttttcgcataggacaatatttcctggcgaatgcgtggacgctcccgccggtaaatcaatcgtggtggctcatcccggaggcacaaacctggttggctggttagaatcggggtgtctgggggagaaagtccatcaagtagccctgggaatggcttgctacaatttcaacgaagttcatacgggaagctggtcagttctagcttgagcaacagttgcaggaccagccccgagtacgcacttgtcatacacacatccgccagagccctctgaagagcttatccaagcaaaataaaccagaaacggcagtcaaaccaccacatacgaccatacctaccaggcagcactggatcccgtctgctctccgcacgttaagctagtaaggggccgattagtagttgggtcggtgacgaccagcgaataccggctgttgtatgttggctttttgttgctgccaccaggtacgcttggagctgaacatgttccgagacttcgtaacgggcggccgatagatgttacgctctgagagggagtttggacatccgttgtctgacgtgcgaatcgatattcaagtagtggaaggaagctgaaacgatctggcatccttcatacctatctctcttgtctaacatgcctcgggatttttttatggactcctgattattcattttggcctaccaagatctccctaatggagttaatcacaactgcgttgagtggcccagtcacatgtaatgcctggacaggggaggcaggtgttcataaaccgcataatggaggtcaggaactcgtgtatcttgaaataagaaactcatgtctgtgcactcaatttggagaccaaagctattgtcttagaatcttcttatatactgatgtttgtacctgaattcgagtgattcaaatgagtgctaaagtttcatgactcctgtttcctaaaccttactgatgcgaaatgtctatggtaaatccactatataagcgcctaacatgacggactcccattactaagacaaacccttcgcaggaagtatgattactgtcttgcacgatacgtcgcccacatgttcctcgttcttaggccctgtcccggagtgaatttgttccagcacgattgccacgcactactcataaagctgtccgttgggtcgagtccagggaggtcagggcatgtatctcggccaggcgggcaattcagatctggcccgttctcagttatgacaaggaggtggacaggcgtgtcgtcaacctattggcccatgaatcagtaacttgattttgtcttaccaaggcttagtaactcacaaagtcattgtctccgtttgcgcacgtaaagggatagtcgccgctttcgatatacctagcactaatcagtcattgtcatcgagggaaagagttatacagcctcacgtgtgcatgaggcccatccaatggcccacttcatgattggccagatcgccctcagtgtatctctctggatatggcacaaatgatgggccgatgccaccaggaagcgtgttcgcttgtataacaacgccatccagcttgaaattatcagatccttcctcatagtcactaggtggggttccaatctgtgaattcgatgttagtacttggccagcctccaatatcgacaaaggacgagtttgttctcaatcctcaacttgaagcaacatcggttgggtaatgaacagacttacgcccagaagaccgaacccatcggtcaataagacggtatataggttcaaagtactgtatccaccctgtcgtaaggcaaatttcatatcaggccatcggtcgaagttgacgcttgtccaggttgcattttccgtataggttgtgttgatcagatcgaatgaaaagccgtgcggggtccatgctttgttgagcacgtcaatttgggcatcaatttgactcttctatgtacagatctggaagtcagtaatcataaaccgtgccgagtgtagtaaacattgatagttttcaatatataccggaatatagcctccttgctcagtctggttggcatatacgacgtgaacgacggtaggaataatagttgtatcgatttctcgaacttggtggacttggagttgctccttggctctcatttcgcgcgccatagcgcgaagagactcagatggcgctggagtgccgcatcgaggatcattcacactgggtatgggtgtgagcaactcagcagccgcacacgaaaccagcgctgaccagataccaatagcgcgcatcgtggctgtcgttgattgctgaaataaagtttctgggggattgtcttggattcgggtatatgctaaattgaagcctgtgaatgaatgagttgaataggcgcttgatgtccgcatatatataaggaaaaaaagagtctatgtttcttgcctcgggtagcgatacttgatcctatacacctactccccgatgaatccgagttttgcctaaccaggaacatgacattcagctttgctgctgtgttttacctacctattcggatattttcagtaagcgccaagagtgggatagtcgtcaagtcatgctaaaatacgagatgcttaagatgccaaggcacctctatactagtcaggttactgtctggcgtaaaagatacgtccggatccaatcacgttacgtattcagcgttgatccttctatagaggaaaaagtctagtttgtagtatataggggtataagctgagacgcatttcagcatcacgatagagagaatccgccccctggtcgcgtagcttcaccgatatatcagccttcaatacgaactcctgttgctatgtgaagtgtagctgttccacgctaacatgggggacaaggacaaggctcctggccagaagcggtagcattctggcgatggtagtaagcgggaacaggccggcttcctttcacatacgaccacacctaccagagaaaactggatcccgtctgctctccgtacgtcaagctggtaaggggccgattagtagctgggtcggtgacgaccagcgaatcccgactgttgtatgtttctttttctatttttttaccctattcaatgaagagcggtgaattgtccttgatatactgtttggcggaatttgtgaaccggaagttggggtattggacttgcgcgatcccttccaccgctgccacggttttatatacttatacactcgaccgctctataagttctaataacattttaactacgaatgtctacgtaattcgattcagggtagttatggtattctctagaccgggggcaatacatatcatatccatcatcctttgagtagaaaacggacgatgggatctcccgcgatgacacccctgcccaatcgcccgctatatatcctcgttgagtccccccttctctaatctgactatgggaacgtaagcaccagcaagaatatcacttgcgcctgttgtatctttagcggtttgaccttggaatacaccgctatgacgtagcgatcagcgactatcacagcacttcctcgctgatagtggtcagagcgcacctagagcttttctgataggattcttgcgtgtttctatgtcttgtacaagtttgtttcacagcctatgttgttgaattttatgcgttggctggatatctctagtagcaaatggtcggagcacgcattcactaacgagtcgtctaccttggaaaggttcaagggaagctcatttgcgcctgtagatactgcatatttgaggctggtaaaggaagctaaagatcttaggttaggtagattaggttcgtgacagcctcttccagtgtctctatctgtattggaaatttgtctagcttggcatccggcttgcaactaaaatcttgaggatcagacgcgaggggttggctttttcatcccctctcattgattggtatagacactacagaaataaaagatagcgtcacggctacagaaggaaagaataaataagaggtcggaactttatgccatgtcaaatccataaagcgaacctaaattgaagtagctaatgtaactttcacattactcgttgaagcctaatcataagccaatattttctttagtgggcaaagaatatgcagcttgaggaccaaaaaaaaactctggaggttggttggaatgcgagcgcagaacattccgatcggctacctgtcgatgacgaagagtccagccatttgcgtttgtcgtgacctaaatataaatagcacgtcttcctcctctcaggaaggaatccattataaatagcaatcggatcactttgtttctttatttaacacgtctttcgtactcatttccagtatctcttcacgatgatgtttggtctccgaacaaagccgactgcggctttgttgctcctactcgccactgctgccaactctctaccatcaccaagcgactgcacggtcactcacaccgtcctctttgggtataaggctagcctagaccctcagatcgtgaaagcggtatgttaccttccctcaagttaatttaatgtttcagagacaccctttccaccaagttagacaagtcttgctaatacatgtcagtctgtcgcacaatttttgggccttaaagaggcttgtgtgaatcccgaaaccggcaaaccctatatcatttctctgaagggtggccaagacaactctcccgagatgtcagaggtaagctgaccaccatcgtgacttacaagcatttcggatcgatttaaactaacgcgatggcgaacgacaggacggcgctacacacgggttcgtagtagagctaccctcgcctgaagctcgtgattattacgttttccaggatcctgcgcatcagaagttcaaggcggatgtcaagaatctcattgataagtctatcattgttgactttatcgatggtgtgtactaagacggttgattgagtgtgagtgttgatgcagtagggtttgggtcttcggttactgtctggctactcgctattgctaaatcatctaatctactacaaaaactatttgttggatgaaaacactcactgctaccagataggataacaaagagagaatgtgcttaacttaggaaaggctcactctcttcataggctcgataagctattcgctattcagaatgaattcttattaagtatcaaatatgttttccgagctacctaagggatttccttcccgtaccaactttctttgctggtgaacttgtagaaacttgcacatccgcagaagccatttcgcttaccctattgtgcatcatgcgtttacaacctaacacatgaggttaggatctgcagtatagtggccctacgcttctattgtgaattgtacgatggattagtacatgcatagtgctattgatgaatgttgggagagtcaaactaatgtatggccagcgacgctacggtcttagctataggccaaatggtctgtgatcaataaccaagtgtggactgagcagcgagctaaggatgcatttagatagtttccacccactactgcaagccatcgaattggggctgggacaccaattgtctttgctgggctataatacgctgtactatgtctatgatcgaccaacggccatacccttgtgggagacttcaggcgcactgtacttcccattacagtaggtcttggaaagtcgaaacatctttcgtctgacgcctcaaaaagaggagtaaaagtggagcttgcctcatcaatatcagcatggattttgtgccactctggcattgtgacgtgttgctttgacttcttgtcctctttgatcctcggcagcacgcacgctcatcatcttctgacctctgcttcccacatctgagagaagcaaagccatgtctgacaccaagcccaacccgccggcggccgaggctgctcccgaacagcctttgaccgccgagatcttgccagacgatgacccggtacgacggctgtcacgccacgactgcttccttccccttctcttcttcccggcacataccacagtctaacacactgcaggatgtcaccgacgatgatttgtctaccaatgcgacggagtctctcagctctagtgttcttgcctaccgaacaatccagggcaggacgtatcacagcgagcggggcaacgctcactactggtaatatatctctcaatctctgcttactcttgcaggcgctctttttgccaatgtcgcaagctgcatctgagcaagtcaactaacgcgcgtacacccacaggggttcaaacgatgcgttgcaaaatgagtccatggacatcaagtacgtcggcactagctcctaagaagctatggatattgactttgacagccaccatcttctcacgctcgctatcgacggaaaactccacatggcaccagttgataaagacatcgaggtttgtatagttgactgtggacttgatgcactcccctctgacaaaagccgtcttatagaaagccgttgatatcggaaccggaaccggaatttgggcaatgtacgcatgttcatctcttcccttccacatatgcagctgaagtaaccggtacacagagactttgcggatgaacaccctgcttgtaaagtcatcggcacagatatctccaggatccagcctgactgggtgccacctaacttggaattgtaaaataacatacccggtcccccatgtcgaccctttaactaataaagctcatcagcataattgatgactgtacgcaagagtggacctttccacccaattcgattgacttcgtccatatgcgatacctgacaggcagcttgccggactggaatgccttattcaagtcggcctttacgtgctgcaagccaggaggctacgtggagagtttcgaaggagcgccgtggctggagagcgatgacgggactgttttggaatcaagtgcactggcaacatggggtaaactcttcgtcaagggcggagagaagctggggcggacctttaccgttgtagacgagcagcttcagaggaagggcatggaggccgcaggttttgtcgacatccaagagttcaccagaaaggtagtgttttcttccacgttgccagctttaagtgttgttggacgattggctaacgcttgccgaacagttacccttgggcacgtgggcgagagaccctaagctaaaggaaatcggccggtttgcgcaggcggccttggagaaagatatcgaaggctatgtgctatatgtggccaacctccagggctggtccaaggaagagctcgccgcctattatgagaagttctaccgggagatgaaggacaacaaaatacactcctacttccggataaaggtggtttgggctaagaaaccgaatgtgtgagagtttccttggtcttcgttcagaaaaaagagcggtgaagaagtcttgttagaaatggctcagaagagcagggcgaatcaaagggttgtcagagtattggccgattgtgtggaggaaggaaatgagtaaaaggaagccttaacacggctaggaacgtccaaaatgctcattttttcttgttcccacaaatgaaattaaaagtcagactacgatggaattactaaacacacaagcctatcactatcttccctcagtaagactgacgggatacttcaagtatactgcccccatgaggggtctgatagtcgtgtccatatttcctcaacaccttttgcccctgcagagagtgttaagccatcgccttgaggaccagggtcattcagctcctccacctttctcactttgtttttccctacttccaagatactgcctccattgtgatcgtccgtctgaatgaggcccagcatgacgtcggcgacctcctcgggagtaacccattgatctttttcccagttcagccatcggatcttctcgctctcaagccatatgggtgtcttgacaataccaggtgcaacggcagtcacacgaatgggaggcacgttcgggtttggtggtttctcaagcgcagcgagagaccggacaaagccagagattgcatgcttcgaagtagtatacaaagggcatccaatatatggaaactgtgccgcaatgctcgctatgaggacgattgatcccggggtcttgtgcttgatgaaatgactgattgctaactgcgtacatcgaatagggtgcaatagattgatatcaaatgacgcatagcggtttttctgtggtaaatcagagctagaaccagtgccgggcggaatccagaagtttgaagttggctgacatcaaaagttagcacattgttagttcatatgcagtcttgttcctcattgtacgcacaggctcaaaaacaccagctccgggacatatgatgtccgcatgtccaaattccttttcagccatgtcgaacgtttcttccaattgcttccagtcggtgacgtctatccgcatgtagatggctctaggcgttgtgttttcgtcactataggacgaaacaaggtcggctgcttcgggccggagtgcaagatctgcgaatatgacattgcatttgttttcgagaagtagcttcgcgaaggagaagttaattccagatccggcaccagttataatcgcgactttcgagggtacgttaagagccatctccttgtactccgctcgccctatagtatattgggcaagggtcaaatggataaagaaaaggaggaaaggaggatgcgcaaggaataaccttctgtctcctacacatccttaatcgattgatcatctcggcgcttatgattcctcgtagagatatcaaactaaatcatgtcaacctatccagtgatggccccccacaccaactggcaaattcgcagtgacacggagaaaccgaaccattcccgtacgcatcaactgaaattaacaatattatcgtccccgacgaacactctgttccatcgtgggctagaggagacacttgataccccactcacacaccatctagattgaatactacccgatatttctgccgcgtaggttccgatatcagtacttttgttcgacgatcacttccttgcttccttgcatgtgatagcccgcagcagatccgctaggcatttgagacacgttgccggcttggtccctgtcgatgattattcttctttcaaaaacaaaaccggtgggagtaaattaagggtggtctgattatagttgacttactgttcttgaatgtgttctaccagtgctcaggcggctgttgttattgaatctacccgaggtaatcggttcggcatattcaacgtcgacttgcttgagcgccgcatccattacttccatgatggcgatgctttcaatacagagcaaatctactctgctttttatcaccacgtcagcatctggcgtcttcgtcggcttcctagaactcgacagtagtgtaataaagtttgacagcggccacaatcttagcgtcctccttttgatccccttcttgaagacgacacaggaattaagatacccaggtgagtgcctagacgccaacagtgttgttctgtccgagcttggatctcgcgccattacacaatcggccgacgaatcaaccattccaaaataaataaggcggttgatcctccgatgggtgacgatatgacgagcctgcgcacgatattgctgagtgcctcatatacgagaacaactctcagccagaccagtaattatgacgacagaaatgatagtacaaatcaatacggaatcataatgtaagaggcaggcggaagtggtagaagtggttcgaatttgtctgtcatagcggaagtcgagagaaacaactcgaccaggagagttctgaatcagccttttacttgcctagaactactttctcggggttccaggaaacgaaccagccaccgacgtgaagctaacatctgtctacacaataataaagtgaaaaagcgcttatattagaagaatcatcaaccgcccttcaattatagatgcctaaagatgagctagaatactaatatcaagcttcgtcagaaaaataaaataatttgattgcgaattaaaatacagatgacgtcaaagttagagcggaaaatgtattccgccctcgattcctactaatctatcaggcgaggcgaaaataacgcagtcgcagcggctatggttgaacccgagtttgtcttttcagctcgtggaagctttccataaagctcaataatggttcatccaaatatccaaataagaagctgaccgattgttgtcccaacagtatcgctacccacgatagcgtccagcatctgtgtctaggtaagggaagaactcagccagtgtacatagcaacatgaaacatacagtgtcgtgacccccacagtgatgatgcaaagcgactactaaagcctaagtaaaaaacatagatacgtacctatgcaacactactgcttttggatggacttttcttcttcttcttttggcggactctgggaattatagtctcttctcatcacaaactactagggcttctacgctacatttctagcctaccttaccttcatcgcctaaatcttgctattgcagccccttggcgataaactgggcaagagagtattacttatcggtgcgaacggttacgtgtaagtttttcatacagcacatggttgctagtcttaagaattgctaatagtcttcttatgcagaggctcagtcttaaagagcctcctagcctctcgaagattggggccaatttcgatctcagttcttgcccgagacacaacgtctcacagctcttcaggacaaagtctctcttatatcattccaagacctagacgacacagattcattggaaagcatcgccagtaagttcgacattgttatccattgtgccaatggtcatcatgtggactctccacgagccttcattcgtggactagcccaaagaaaaaggtcacttggtggcaaaccacgatgtcgtaattaacctcattattctcagacttcaggaacatccagtctaggcgagtacggaatcacgaaacgatacgtcgaaactcgaacattttccgacaaacaggacgatatcttcgcgtatgaggagcgtcgagaaaacattgcggcctacccgcagagaactgcagatatttccgtcgctcaggcaggagaagaaactgatataaaaacgtatataatgatgccaccttgcatcattggtcgtggtacagaacagtatcgccaacagtctcaccaagttccaatgttcgttcgtaatgcgatacgacaaggtcaaagcgagttcgtgggtgatggatcgtacacggtaggccatgtcgatatccaggacctagccaatgtcttccaactcttgctgccgcgacttctagctggcgaaggcctaccatgcggaagacgagggatctatttctccgacacaggtagtcacacctggctggaagtagctcaagcaattggtgcatttggccacgagttggggcttttgggggatcctcagccgtaatcggttgagttgtctgaattcgtacgtcgtgaatttaataaagactgtcacactacagagatagtcctagctgccaagtaagtagttcaagcccgatatagttcttctcattaatttataattcactcagttcgagaagcttgccagagctcgtcttgaatattcgtcagtggcagccacaacagacgaaggtggactgctttgatatcgtccgtcaggtattccaatcacagttaggatagccaagagacaaggagatggattgagaaccagaaaaaaaggacgaaattagacacgtttgattgcaaaattaataatgctattcacaaaaaaaacacaaactcgtcgacaagtgtaacaaactactcaggtggaagtggtagttcaaggacggtgatgtcaaagatacatagtgatggagcatgtagttaaaagaagaacattgagcgacgtaaataaaagaacactaacgaagttaaagaagatgattaattcatattaagagttccaatactatgttgttaccgaaattatccgcgattgtcggatcctaataccacttgaattgggccatgcgctcatcgctataatcaataaacttactcccttccacaaactgatagatagtagcatccgtttccatcatgacctgagccatgcagtccacctcggagaccttgccctccgcatagaatttcttcagtaactccagcaaggcgtactctgcccccttcatttccttggactcaagccagtttttcttgcctttgaccataaacgtatcttcaccaccagtagggttaggaactatgtgcaatgctgcaataatgctcttgggctcctgcttaggatctttggccagtatcaaccttgtgtctgcgatcttcatttccgttccatcggggagggtcgcaggaaactctccctcgtccaccacctcgcaccctgggaaattggtggacagaaagtgttttgccgacatgaccgctacctgcggcactatagcgttgaagaattcgggattctcctgtgcacgggtgcgcatgtgctccttgatggcctgaaaatggctttctgactcaaagagctcatgctttggctgctcctttaaactgagcaggaatccgctgagatcagcgtactgtcgcctgtttgattcgtgaacagtttggaattctgggcccatagcctccggggtaatggtgcctacatcgccaacgaatttggagttcttcctctcagttccgatgcaaattctcaccgcgcaagctcgaactttgccattcttgtgcagtgtcttgacgtgctcatgcagcgctttctcggctgcagcgatagctgggctgtcagtgtaatctccgcacttcggccagatcaccttggggtcgatcccgagaatcagagtcgtacagactatgcctcctgggtctttatctgggtccgaattcctgacgaggaaagcatcggtgctatcgtttgggtccttgaaggtcacgacttcgaagaaggttgagtcaactctctcggaaattttgttgaagtccctcgccaccaatagtcttgttggatattggtaagggacgccatcaacagtaaatgggaattccccttcgtcccaggtggtgcaacccggatattcgcgctcggctcgttgatatgccgtagtgaacattaatgatggaaactgcacgggcatgttttcgggatcagcaagagccgcctgacgcaggtcttcgtttccagacacgaactgttcgttgggcttgtcctggtgcgggagcatggttatcgtaggctcattggctgtggtgctgaatttgcagctgaccaaatccgcgcccatgaacacatggatcagggcatgtttgatattggcgttttcctcaagcatcagggtaaacaatgtcagcatgtgtcttttggcctccctcatctcttccgtctgcagcgctgcacccgccttcatccagggttcgtccgcccccttgcctttcagtggcggggcaatgatcatagctgctgaatagatcacacccgtaaagtcgtcatccaacgtgaggacagttttggcaggatacttgcttttccgaccacctacacagagcgtagtctcccccatgtcctcaattgtgccggccttagcgcaggcgggctccgccttgtcaagccatttgcgcacagtatagtcgaggaaaggctgaaacgaggcacgaaattttttggcattccctctttcgaacgcgttcttccattcggcttccattgtttccgaccactctttgttgatctcccattgaacatcaggaagttcgatctgacgcatttgctccgcagcagtgttctgggccggcctggctccagggccgccgccaggggttgagttggtgcaacccatagtatcgtcaacgacgccctcgtgagctacttaatcaagtgacttcgcgagctcggaaggagaattggatggccaaaacaagtgagagagcaggtgcacatagaaaccgagcgtaaacgtggactcacgacgggattttatgttcagaggattgtctggtgctcatgagtcatgccgataaatcttaccatctggactctggctatacctagacagggatctggctaatgaggatacgaaggatgcaacgctgttcagtagttttcggtctaggcgccttacatggggatcagttattcccgggtcagccctatatttaggcctccagtagtcaatataatctaggtatggaaggtggaacgaacttaagagagggaagcctgtgagtcacgaagaaaaaaaataccaaatagactacagctcacaaaccgggctgttcaggaggcatagaactgccttgtatcatcatggacgagagtgatcgacacagaaccttactcttgagcaactacaatcagtagacacaagacaagtaggcaatccaagtattggtaattttggaagctacccccagtcgattcttctaacttgtcttctaaagaccgaagctgatgaagtttaaacaggatgaaacttcggatatggaccgctctcataagaaactcgtctcgctgaatggagatgcttcctgaaggcaccctataaccgaaagatatttctgtatgccgtatgccatcaaatcgggaattcttgccccgtgttttgccggtttttaagaagtcgaaagggccgagcgacgaagcagaacagttcacagttcgtctagatagtctagaagctggaattgttctttagtttttgttgatgtcaatggtcgtctcgggcaggcagatactaggctggagcaaactgatcatgcaggaagcggaatggaaaaaacgaatggaccaaccaacagtggtagagatggggcgatgattgttactcttctcttcgttgccacaaaataccggggtgctgctcgagtatgcgtaagaaaaacgaggcattgctagtgaggcattcttgggagcgaagctcataccccaaaaagccacggcgctattcttagggcaccatcgatgcatacatagaatcaaaacgagaacgacagagaaaaactccacaagaaaccttcagaaccatacccaacccagagagggcccagaggaatccaaatcgcccaactacttttatgtgtaacagccgggcttccctgcttactggttgccttgcctccactaaaatggccccagacataggtaccaagaactagaacgagaacaacaacgaagaaacagaggaaaattgcaagatctcgatccatttgcttcttgaaattcttttcagccactgcgtggactgtacgatgcctttccctgaattcaagaggcgactcgttgtagattgtggatgttgattctgtacgccatgatgtacgtgtagtgtgccccgaagcagttcctagttgattgcggaagccaatatcatgctgatgtcgctgctgtagggagctgaccggaggtgcgcctgttccgacacccatggtgaaggatctggaggaggttgccccagaggtgtaggtagtcgtagactctgtagtctgctcatctgtacgcgagtcatagcaaggatggtccttcctgttaccgtcggcgctgaagctgtgagtctccattcgaaatcctatttgacgtaagacttttggtttttgaaagactagtttgatgtagcgggttcttagaaacgataaataggtctagagaattaggcgtccctcgagtggagaggattgctcatcaaagtcgtgtttcataccaccgcgaggctgatttcacctcgcttacgcaatgcaaccctgcagccagctcatatcggatagcgtccattggtcattgggcacatcgccgtatagctagccgaacgcgagacatcagattgagtttcttcattcccatggaaacgatttcccgggtaaggaacaattggttggttcggccgggactcattgcatctatatttagcccgtatgtattaagcgcagaacgctgtgaccccagcacggagagacaaagttagtgatattagcgagtgcataaaagaaggttcgacattcaaggtggcatgagagttgcttagataaaaccggctttgatttcccagtcagaaacaagtgttccatcactgatggacgtagacacattttggcaaggtaaagaattgctgtagacatcgctatagttcagcgcaacaaaaagtgtgtggataataaatacgtttcggaattgaaataaacctactgtagtcgggttatttgatggtgtttagccgtagacttcgctttgtgacatggcggtcttgactgattttgacaacggctgtctccttgtactgactgtggcagtcttcgtatcgggcctaattgattacactccacttctgcgtcttccctagagtcgatgtctcgtggaatcttggtctttctcgaatggactagtaaatgagatattgagattcttatattggcttcccgtaggggatcgcctcactacaacccagaaagcaacgatcaatttggattctaattaaagctacagagttgtcacacatgtatgtactcatgaaaatgtatgcctatgtcaccaagagtctcccttcatccactgatttggcccacagcaggcatctgtttatcccattcactctgcccgttctcagcaagatcaaccatccaccttgcaatcgcattgcgattgctccaaccagcgattttggagtcaccaagatatccagcgtgaatggcgccctcccgatcctttttccaactttcttcatccgttttgcccacaatattttgaaagcggaataaggtccattcaaggtccgtcgcttcctcttggaatacttttgcggttgcctgaatagatggtatcgcactaggggcgagcaccctaacgagaagtttcattaaagtgacgcggaagacgaaagaatctttgggatctggtgcagagacggtcgaggaggcgatgatacgcttgacgttgttatcgcgcatggcaggaaatacaacatcccgatagtaatcctcgaagggggatatgggagacccaaacgttggcccaagtaaagaaagaatgatatcgacaccggacagcgctctcgtgaaagcctccctgtcatccatggctcccttaatgacctattgatgttcttcttagaaaagtgttctgcagtgtaattttaccatttggacttaggcagcttacggtaagcagagaattcgacgaaatgtcgtcgggtatcttggaggggctgcgaacataagcaactgtgctatacttgcggtagagcagctctcggaggagactgatgcctgaaggcccggtggcaccaagcacgaggacttttttggtagtcattgtcggttttggttcctagattgctattcaatcgtatttgtgttataaaaagcgtctcatgtcgaccgaaacggcgtatcttggctcatttatactcttcctgtctcattatagtgtctagcctggtatgaggagctccacgacaccgctccgcagaaaggagcggaattcggtgccacttcttcgtaaaaccgaacaaaaaaggaatagctcaggtttgattacaaaaccttggatgatgctccatatttagttgcccttcagaagccccccctccttcgtaaaaccaaacataaacagtccagcttgcggatcatcagggaaaacgctcatatttgtactaccctgagactgcggagatttcggagactccgagtgatcttgctgtaccgcgatgcggacgcaggttcgaagtagtgcgcccaaatcccggactggatgtgggacttgtaagtccaaagacacgtgcaccggcccctaatgtttgatactaacaatcgaaaggcaagtaagaataatcacatatgcaccttcatacccttactggactaaatggatgtagggaacggcatgttaggtgtgacgaggcgaaaccatactgccaaaactgtactaagtctggccggacctgtaccggttaccaaatcaaacccagaaagaatcgatccgtaagatatgcagcagggtttgaagccaatcactcttctggcttcatcctgtcttgtggtcccgacataaactctctctatttcaagaatgatcttgaggcccagtatttcgatcaatggagccacctctctcagtcgttcctcggcggctactcctccagtaagctatgggccgtattcatgccccaaatcacacgccaagatcctatcttacgcgacgcagccatagcaattggggcaatgagtagagctatgtctaccagttgtgcaggagggcatgtcgaaaagacccttcatcatacgaacgcagtcgaccattattgcaaagcacttcggctccaggcacaagaaaacctcgcatccttggatatgcagagtctcatgttaggctccattctcttcatctgctttgaggcttttcgctccaaccaaaaagcagcattgcagcacatcgctcgcgggacccccttactccagcaattgttcacgcacgacaagtcaagttcccatatccgcaaaatagcccccgacccttgggaactcctccacgagatcgcaagagtatatgtgtatctgggcgttcagacacagaccgtgatgagtggacgactggacagaagccagtccgcaatccggacactggctcaagacttgcaagccaagggctacaacgcggaaaaggttgatgcaaacttcgatttctttttgaatcctcggcggaaaattgacctaaattccttccctgataacttttccacattggcagaagcttgcgagcattggtcccttaccgagcgcaaaattcaaaaatacttccctcaacttatggcgtcgatgccacgcctgatcattttcaatgagacatttcaggatgttgacaactttttcgatcagctcgaacatcaggctgaaatggacatcttcgtgcgcagcgctcatcagtatcttgacatctggtaccaggcatttaaaccgctgcgattgagcgcatctcgcaatcgctcgtccaacccggacctgtaccatcagaccatctatcttcacctccagtatctcgaactttatctctttgccatgttcccaaaacaaggcaactatgatatagtgagcgctcttacgcctgcatttcgccagatgaatgagctctgtgagtacctggcccagagctgtaggagagagctcaacgcagatgaaggcgtattttcgatgcagtcaaccgtgctctggcgtttgatgttcgttgcagtgaattgccgagacgcaaatacccgtaacgaggcgatccgcatcatggacaagtatccccaccgggacggcatatggaacaaccacgcctttctagctatagcagagcagaatcgtaagcttgaacttgagaatggaaaggagggctctgaacatgagcaatggcggaggctctgttggagggtgttccgtttcgaggacgccgggacccgcgtggtcttccggtccatgcgcaagacagatacttggacactagtcgaagagattgcagaccttgagcaagtcaaacgagatggttggaggaacaccatgtgggaaagagtcccgctgcatacgaaaaacctcatgctccagtggggaaggacgacaggcatcgaggcatttcgagatccttcacggttatcgaccggttgcgtatctctcaacatcacttagttcacctgcgggatgtctagatagatgggaaatacaggttaggtatagcccattgctttcggctggtcgtatttatcacataataccaaatatagactacgcatcagggtcaagtcgttgataccaaactttggttcgtattgcaactttgtgatgtgtacgattaagattcttagggagatgtgtgtatgctacctgcaaatcataaaatagtgaaacgtattcctcatttctcaagcctcattctggttttgaacaggaatgttcttcagctggtgtccagaatctggcaaagtagttggcgatgctttgctcttgttgcggcggcgtctcctccctctccaagtcacccacaaagtcagagcagcgataaacactccaacgacagcaacgatgatcccaatcagctctgctttgcttagcttatctccgtcgcgggaagatgagttggtattgccgctgtttccattgctgcttgtggatgaagaagtctgctctggaccttttgtgattgtaattactgacgtgacaccgttgatgacgatctgtgtgcttatcacaccctgtgcagttgtccaagattctttcgtcgtcgttgtcactgcttcggatgtttgtgaactaacacgagagttcgaagtaaccctagctaaatattctgtcagcttctatcctccgttgatgatgacttccaattccatcaatccaaaccattctggtcgaaaagagcgcatgcaaatcctaagggcggcgcaccaatttgtgagcaccgtcagtgacgtgctgcacgtaacagcaggtttggcgtaaccagaccaaaaatcaccgcttgacaccatatcatcgcccagctcaaaatttggggtcgtgataatgatctcgaggaaactgcggacacgaaaaccgtctgtgtcacaaccgacactgtgacagtctcagtcaccgtgaacgcacctgtcgagctggctatcacggcagagccgatgcttgtgtagcccttatcagagcagtaagcgatcaagaagcttgtcgcgtcccgttgatcatcgtagttcgagcaggcagacaacaccgaatcagataccttcttcagtgtctgacccaacgtgctggcccggcacatgcaggcatttgtgctgcaaccaatgtccccctggagattgcctggccagttgcaaaagaggtaatcaaacttgcacttggcacatgttttcatgtcattccaaccggattgtgtcgtccaaacgacctcatccttatccacggcctgcgcttcgcagtcattcagtagaaagctcagtaacaataaagcaagaaaaggaatcttgtgttgtctgggcataatgacgcatttagtaagtgaaagattgaagctgatagagcccaaaagactgcgtgatttattaattacagcgccagattgtgtggcaagattgaagaaaagaacgacacaaatgtgcaaagaggttgggctgacgagctgagggcgagacctcgttggatttgaaatactccgcccaaaagaagctgcgctactgcacaatgtcttgatagtgccttcttttgtgataagtctattaggtcgtccacttctcaccaataggatcaaggtggcttgcgtgcatatgggttgttcattgggcgaagatttcagctctccgtaacctgcatgcctagtgggatctacaggatggactcattctcccctgtctggagcagacacaaaggtaggagttccaacccatttttcagccaaacaagcataatcccaagctattacctgtcgtgtgatttgcgaggtatgaccatgaaaaatctctcttgccgtgatggaaacgaccatttagtgcaggaagaacatatggctcacttcatagctttaattatggaagtacttggtaaatgaatgtggcgagatcagcagtgatgaatagcggtgacttactgctgagaataggcagctcatcatgtcttatcacttagtcaccaaggctttcccgacaaagttgtattcattcaaagaggcctaaatttagagcgaacacagtgttaccctcaagaagctatgaacccaataatggtatattccgatcaaagttccagtctcaccgaatcacatagcattatcattataaacttgagaactggagcttcttttcccatatcgttcaatcctctctctcaactcttctagagagttatttgcggtatcttctcttcaacatcctgacccgtattgaactcttcccgagaagaagaatcctgcctattaaccccgattgttcagtcatccctgattgcaacatggctaaaagaaaatcaggattgctccaggcctttgcccaagttttaggcaagccccccaagaagtctcgcaagaagtctcacaagaaatctaagccagcatcggatagcgggaaaagtgaatcgccagatgagcccgctgcgaagtcgaaaggaaaggcgccaccaaaggaggaagtcggcgaaccatccacagcgccaccaaaggagaaatctgagaaagagaagaaaatggacgcgctaaaagctaaaaagaaaggcttgaagagtcaacttgaaacgaccgagggaaaaattcgccaaaccgagaagcagtattgcgataatgaaatgaaattcataaattggtggcaaaagcgaacagatataggcacacaggcggcaaatcagcttgcacagttgcgtatggatgcctacaaagagcgcaaagaccagcttttagcagatctggacaagctggaacgcgaaggcgataaattatggaaaaagattggccatgctaaggttgatatccgggtggaagagtattctgatgattcttcggactcctcagatttctcggattcctcatctgatttttcgttttcttcagattcgtcttattaaagggcggcctatgatacatttttggtggtggcatgtagccatgaaagcgtctacttctaccctctacacgggaaggcttggacagaaattatctccagctatcacaacttgaaaagtccagctgaattaagccgatcatctccctctacagtaagatgaaggctgctcagttgactcagattctcaatagataatagatggctcaaattgatgtccttttactccatacggacccgttactgttactagatgcgcgcattcgctgagtgaaatgaaagacacaacacgcatctaaagaattcttcttttgcctctaattgactgtggatgagctggtttatcatgatttttgtattactctaactttagtgatatacattatgggaggaattaaatggagttgcagatggcctcatgaaatattagccagtgacgtggagaccatcaagtgttttgatgaacaaaccaactcacagcttgaggctatcaggtgatgtattgattgtaggccgagagattagtcaatagcatgacacgtctacttctggcaagaagcttcttcaaaagctaagagctacgggattgtggaaaggagcacttccgcgccgcgagggagtcggtgataccgtcggatttccacatttatagcaattcaatttgcaattcacacactatcaaaagtaagataccctggcgtttacacatgaaataattttccaacgaattagagaccgttgagaatgtccacattaaataggtatagcatttatatcccatctcaaaggacaagggcagaagcaagcccaacgacaagcatttatcatgccttctcaaaaaccttttgatgcttcttgagtcttttcctaaggtctttcatgtaatatctgacaggcatacttcgtacccataagggaagaggtcgataaacagattttacgccgaactcgacaattttgtacgtcctagggtggcgattcacaccaaactcttgacgcattctctcaggaagcagttccgccgtgaccacacgaacagtaggcatgaacatgcggaagtaaaatggagcgttccgcaagtacagcaaatcatctcccacttcccttgcgtgctgtgtaatttctagagtggcaatcttctcatcccagtactgccagaattcggctctggtctttggccacatctccggtggcacccgcaaagagcaagcaaggatagagtactcctggaagatcttctcatgaagttcctcgtcatctatttttccatagattcgttcgtatatatcgatcccgatcgcatataacgtagcggcaacccacatctgtaggtcgggatcgttggcatcgtagtgttttcccttgtcttttccttcgtccagctttccgtatacctggtcatggattttaccgaccaagtcaacaatctttcgcttctcttcgggcgtaccgtagctcattgcataaacgaatgtcatcgtggtgcgaagccggtcggcaacacgatatgagaagttgctgtgttgattaacaccctgagcaacgccggggctggccacctgcagcaaaatagcagcggcacctcctccaaggatgatgccctcctggacgataagattgatgtgctggggattgaagttgtctgagaggaagtcttccttgctgaactggaaaccccccttgggcttttcgccaataggcgacggctcggtgccattgcttaacgtatcactccccatcttgaggatgtttggagagttcttataagatgtttggtagtttattgtcaccggtcgaattggcagtcctttgcaacgtggatgattcagatatctctctctgtctttcttcggactgactacgaagacttatatactccatcgccaaatggccttcaatattccctagtccgttaccaaggcaccaatctgatgggggtacaaataactatcgttactgactcgacattcaccagccctctatcaagtcggctcccactgagtcgcttcgatgactgacgacgagtcatctcgcgtatccattggagactataggcgttccaaacctcggtaagcttgatgaggagattgacccaaagtgccaaaccgaggccagccagagccaatcagtcagagcagccttgacggttcaagctgatcatacgagcagggaaaccacctcgtcgtgggaatgataccccacttgcacctagtacctctgcacgctgtgagaaaaaaaattcgggcatgcaaaaagagcagctctctccactggatgacatattacaacgcctgttcaaaggtgcgtgagacaacttgcctcccctcccaatgtaaagttgcaggggggttggaattcgccgctattggcggacttctctcacaggtgcatgccaatgtgccatgctagataataattacagggtcacaggccaagccttgccgctccatattctatttggtaggtccgctagagatctctccccgccttcattgccgtgcatggtggatgctctccctgtcaaacctcagctctgccatcaattgggaggcctaggcaatggcggctgtatcccattctatactcccatatgccattatacggagtaccaccttccccgcattcgattcaatgccgtatgcagaccctagaccgaggtggcagggctttgcggtctattcaggaaatttctgtgaattctcatctgaggaatccttgtagggctctgatacacggttgttggccagctgagcacaccttcatcttgattgatcctcggaatagacgactagatgctactgaactgagctcggtgcccatcggccacctaatttgcaacacggctgctaatcacaacgtcaaacatggagacaggacatccacacatctatttgggaggacaaatcacggccgcttcgagactaccctcgttgctagtgtagtcccaagcccctctttcaacaatccgatgcatcacaactcctcttcgcgaaagaaaagtatatgaggacggcagcagtgaatacccttactgtgccttggcagctagcataacaatctggtcgcaacgcagccctacttagatctcgcaaattttcttgttcggcatcaggcaaaaccatgggcctaaaaaaaggcggaaaggagaaggagaaggcgctcgaggagtttgagaaagcttcaggtggtaggtcatcaatcccggcaggcctctggatgttgtgtgcactgacataaattacagcacttgaggttcaatcgatggattccaacatcaagccagggaagatcaaccttgtgcacattgaggatattcaaaatccaaatgagaaaaggaagaaggagaatatcaagaggaagaagagaaagaacagaaaaaatgctttcacccgattccgcaagcacatggtcaaatattggctatgctatgccatcctgatcattgttctgctggcaattggattgccagtgctgtaagtctgacgcatctaagaaatccgcaccgcaattcttgtcactaaccattcataaactaatagattcctcaaaatcattccggctctagcacagcgcatcattgacgatacagatctgcccatttattctgcgacgctcaaggctctgaccaatgatagcgtgttgattggcctcaggactgctttagatgtcccgctcggcttgactgttggtctagatcctgtagagttatggctctacaatgcggactctgagggattcaacccgtataccatggttcgtcttgatgaacagaaagtcaaaggacacaccgagatttctgtacatgatagcacggtcggtgtgggtgaccgcgacgagctggacaagtggctgacagggatgctgaacaataaagaggccgagatcagtgtcaagggcaacaccaccgcccatctcggcgcacttcactttggcgtcaatctcaaaaagacggtcaaggtcaaagcgttgaatcgcctcgacggattcggtcttgttagtgcccgaataaagattcctcccgcggaagacggctctaatctccttggggacatgatacttcccaactggtccgacctcaccattggcctcggaaatctaacattcaatgtctgggctggtcaactcctcatcggccaggtctcagcatttgatgttctgctccctcccggcaactccacactgcccttccgaggacaggtcttccttgagacattcctgaagaaccttcctgcagtcattggcagtcaggcggcatctcttgggagtggagcaatcgagcttggtctcaacggaaactcaaccgtagtcaatggtaatcatattggatatctagagaaggttctgaatgctgcgaggttcacaagccaggttcctcttttgcagcttctcaccgacatgatgcagagtgtagcgtcaggagacactgacctcggcggcttactcgatctcatcggagatggcttggactccttgttgaatggccttcggggtggtaacagcaccagtgatagtggcgggggagccttctcggacattctcaagggtctcaacgaaacttggtttggggatggaaattcgaagagagatttgagggaaatagtcatagcaaagctccaacgctaaaggataacctcagtcgtaatgacataattgaacacgatttccttctgattgtgctatagccccgaaaattttgacataggccatcgtccgggaattgggggccagcgagatcctctatccggattgtcctcttaccggtcatatggtacaacagtaggaggggctgatcctttccgcatcatccccgtgactagcgaggatgtgcctcggctggcataatccatctctttcacgtttattaacaaactatgtttctcagcaaattacatagctcccagcagacaaacccaaaaatcccatgcgaggcggcctcataccgcaacgtgttacatttgcagctatggcacagccattgatcctttcaccggagccgcagctttccggggtggcgattgccgagaaagtcacagtggaatatttcgagcaccaaatagaaagtccttgttcagaaaagaacggacttctactactcgccgagaaagaagagaaggtcgataataatcctttgtcaatagattctatgggaatggtcgatgaagtccttgagaacagcaacgagtctgctagcgaaaatgcagcagtggattttcacaagacacctcaaaaagttccaagaaatggggaaatttctatggccaaggatcttcccaagtacacgatggacgaaattgcagcacacaacacgatcgcagacttatgggttgtcattgataatgatgtatatgatatgaccgagtttcagcacaagcatccgggcggctacaaaggtaaataccagcgcttccgatattaaatggcattctaacaagtgatacagtcattagagcagttgcaggaaaggatgccaccaagaagttcgataaacaccatagaagggctgttcttgcaccgaaaaaagagacccttctgattggaacggtgaatgagagtggtcagctgggtcagtcgaaacataagaaaggtttatttcggagctttgggtttgggtttggatcaaataagtgaaggcatttagacagtcaatcgagcatcaagctgcttcaactacacatcgtatgtttccaaacgcacactttgcgccatggcatgccattgggtcttgagtcagcgacggcagtccatcaaaatcatccaacgatcagataacaccaacacatttgtcacccaggtctgtcatgtgccaacttacatgtaggatgatgcaggccgcggggctttttcccccgcaatgtggacgagggtgggcgacggtaccccgaggcagatcgcctccatacatacatggatgcggggacacaaaagattccaaattcggtttacaattcgccgttgatcattcacgcatggtacgtcagaaatcaccgtcattggcaaggcttacagccaaagtgccgaggctcctgggcgcaacgaatctcttatctaggagtctaaacgtagccaagagcaaagcgagaggtcgttcttcatcgaaaaataccactgatcgttgtcaataagcttccatcccacaggattcgatttcttcaacatttttttgtgcagtactaatacctctgacgtgctcgcgccatggcctgcccagcaggatttggagatgggacgcccacaaagcctggggctgcgttcatcaagcctcacatctttgaatcaatccaagagccacgggagctccggggcttaacccaagattgcatcttcctccttggtgggcattttgcaatcctctgccagtttgcccatcctgggctagctgaaggctcattcaagcactccaactttgcgtaccgtattatgaatcgacttaaaacgaccgcgaggttcttgaacgcagccgtaatgggcactcaagaggaaaaagaggccatattcagtgtcattcatgctgcacatgcagatgtcaagggcccaaactattacgccgacgaccctgagctacataagtggacagctgcgacacttttcgtatctctcatcatcgtccatgaggctttctttggaaaagtgtccaaggctcgccaggaagtcatgtacaaagagtctgcggtgtatgcaacttccctacgcatgccgcccgagatgtggccagggacattagatgacttctgggtatattggaaccataatattgacaccctagaggtgactgactgggcgaagagtctggccaaggatctcatgtatcccagacatgtacccctatggttccatccagccgcgccagtcgcgcgcctgcttacaactcattggcttcccgagaggttccaagcagcatatgacttgaagcccacgcctatcaacacactcatgtatcattttgttgtcgggaacacggctctaatctggcctttcctccctaaggtgatcaagcaagggccaagcaaatactacattagtgacatgaagaagtcggtgaaacgcattgaagagacgggcagttggcacgaaatcaaatcctgagcaggcaatgagttggatacctacattgtgtcgccttgaggcgattcatggctcttgtatgataaattaggatccgatcatctgtaagattgctctttcaattaaatttaaatatctaggctatttataacactactcggtgatgcgttttcaagcttcggtggattccataattcgtcgaaactgctcatcaactctctcttctcctctatcgccccattcaacatttcgaaatcttcgccgattggtgttggagcggagctggaggttggagttgttgccatggtgctgagctcggggagaagatacggtgtactgtcgccatcgatgaatgccccttctgtccagagttcatcgctagccgttatacacgttcccaggagaacgtcaagctgagatctcatgtaagagtaatccctggaagtgggtgcttttgacaggtagaggtatgccctggttgcacatataacagctctcagaggcagaatggaggctgtgcggtggagttcattgatattgacttggtgcaaggcgcctgttgccccctgaataattttcctcgtcatatcgctggcaatgttatccctcacgatgtcccatacatgaacctgcctagtcaggaccccagaggtattgatgggtgctcgggctattgccagcaaggcccgagcaaagagcaagtatgtgttgagccgcagcgttgccagcgcccagttgccggtgctcatcaaatcagttctatccggtttaccttgcccttcttggtaaagccggaagaactcccccagagactgcaatgtggcaaaatagatatcatatttgaaaaacgccacgggtggtgctaccgccgagatctttgtcgccgtgtccggtgtggtcgcctctggtgggtgtaacagagttgagctacaaactatctgatcgagttgctcgcagataagcttccgttgaagaaaacaagatgtcttctgtagtctgcaccagtactcgtttgcggtctctccgaccattaaataatattgagatcctaggtcttccattgtcagcggcatatctgtttgccgactgaattcaaacgacgggttcagattctctgtctgctcctcgagcgcataacgcaagtagtgaagacgctcagcgataaaagctgaccaccatatacgtcgtctcagggaagaaaatttcgccattttcgatttagtctttctggagagaccctgtttgaggtggtcgacgacttgttgaagccattctctagattgatctctcccagatcgaatacccgagcaggataaagaatgaatggctaaaagaagagcttgcacctctattaagggctcagtagtatgtgctatgcaattctagagtcaaacttagccaaccctctcaactttagtttccaagggggcatgcataccttcaacttattgaaatgaacatcaaatgcttcctcgcgactcgtaaacccgtgacgaatcagagtagacttgtccagccacgaaatagttgcaagaatcaaagcatggtgaagtgggctttcaggcaggaatggcgccttgcggttttgccaagatgtgcatagcgctccaatatccagaactgggacctcgaagtaaacattatcaatataactttttgcacacgtagatcccaggttgtcatgctgcactgcccagcaagtctcgtcctccaattggtcgacggttttcaatgctgggctcgctagtacaaaaggagtcgacatcctcgtgaacaaaacaagcaaaattcggttgctgcaaggatgctgcaagtgaaaacgaatgtttcaatctctataatagacacgttcaaccttagagaacggtgtttttttggttattatgttcttgtctttactgtgtctcaaagaaggctgtctttagttgccgaggcccgagggcaagttagtggcatatagtcataattgtctcttagggatgcatgtacaattcgatgctaggtactgtcaatgtactatataattccagcagcgctatcaagggcctgcacggccgaggcagtggttgtcgcctgaaggcgatcattgggcgcgtcgggtatgacgggcgcgtcggttctcacaaccttgtatgtcgagagtccgccgatggtcggtcggtcattgatggttagtggggacggtcatttaaccgtacccacagcgtctgctctcattggaggatttgtaggttgtctgatgctatttcggagcaagattctctgtcaacaaacaacacgtccgaagagcaagagaaacaactggaggatcatatcatttcgttgtttgaaaatgtgaaaaatatgcgaactaaatggttttatcataagacacgagaatatgacaagtacgtaagcagcggcgaccaaatctagagcggccgatccaccagcttagcatgccaaacaatcgactccgatctgtacatttatattgcgagtgttacttcaaatatgcttaagtgtcctcacttcaataccgattacttcgagatagaggctcgagatatgactgctaaggcttccttgaattttctacgccttactgagaagctggccgcaggaagttgaggtcaaagtgctctgtctctagggtagctaggtaagcttcgcataaggcgtgatctggggaagtctccacagggacccacatgtggcttgtttccccgcatcccccattatgcctgctaatggccagcgagttactggccgcacaagtatagcagcagtctgggtgctgtaatgctggggcgctgcgcctgaataggagccatagtgtagggtattagtgatgtacctgttcttctggtggggtgctagcgttggcttcctacttgccagcacttctgttgccgtactctgttccctcacattccccgactgtttccctgcccctaattcatcgttgtccgtcccttcacatccacggacctaccggattcgactctatcccaccgataactctccatgcccaccttatttgatcactcaacatataccttttgcacgcggcagccttgtcggcgcttgccaggcttcagatgtgatgtctgagtctgcgggggactcggatggagagaacaaccggaggaagcgcatcaggcaggcttgtctcaattgcaggtaaatgtcgaccactggagaacggagaacaagccccgcctattctatgatcacatccacattgttgacgctactttggtaggcggaagaaggtcaaatgcggcggcgagaagcccgtctgtactttctgcagccgcctgtcgcaaacctgcgtgtacacagaagatggccggagcaataggcgagcctcgtttcatctacccccggacgaggaggcactcgagtttcttaaggtgaggaagatcccatctggataagcgcgaattgatcctcattgtattgtgtgtgggctgacccggagtagaatgaaatgcagctgagattcgcaaccctggacgatcgcctcgggaatattgaaaacgcaattgcagggtaccttactttctttatacgttgagtttctgagaacccaaactgattcgtctacccatcgcgtctagaatcaaaccgctgttggcatcattggcgtcaatagtcgaaacgagaccccgaacctctgccttggtaccacagccacaaagcccacagtcagaatctcgatgtgcaagtagtatcatgaccaacatctcgccccaactacaaaccatgactccgcagagcatattccctcctgtccatactctgctatttgcagctgatgtgtacttccgcttctgtcacaaccaaccatattccctattccatgaagcaacactcaggcaccggctagcatcgggacaagttcctacctaccttgcatgggcgatattgtccgctgcacgaaggttttcaagtttaccggatctacatgaaagcatatctgacgaccccttaccccttaccaagctggcatgggattccctcaatttaccatgggaaggtgctaaaaacgatcaagaggcagtcgctgtggtacaaactatcgtcttgcttgttaatatagaacatccaggtaacatgcccctctggtaactcgattaaaccttaaatcatcgaacctaacgtctttgtagctgggaactgtgccggctcctatatgaagcttggatttgctctccggattgctttacattctcgattaaacctggagccagaagatgatctaccgcccgtgtttcgagaagagcgcaaaagagtgttttggtctgcttatcttcaggataaattgatttccctctcccgcgagcggtccccggtcttacaagacgaagtatgccgcatctcgcttccctgctccgaaggcgcatttcgagacagccttgaggaggaatgcccaacacttgattgtttcaatggggaacgtgtagatgaaaaggcggcggagcaatgctgccctctcgctctgatatttgtcattggatctgctctgaatcgcgtgtcgaattatgccttgcacgaaaatcgattctctgagcttggacttccatggtctccctcttcgccttatacttcaatctcggcttcccttctgcagttggaggtcaactttggattgaatgatcccacagaggaggcactgggaaggttggtcaatgggtccgcggaccaacaaatgaagggctcttttatctatgctaaagctatcttccacctctcccactgcctcctccaccacccctttctcctacatcagcgacttcagcgcttgcagcaaagagcccctgtaagttttgcaaagacagcgtgggatacatgcagaatgcacgccaagagtatcacggggctcaaggatctgaggaaccaaaatgtccttatccttccatcgctgtacgcatattgtaccatgattgcgggcactatccacgcgttgtgcctgagtgaccatgacccggccatcagtagtgaagctaacatccacttcaaatatgccgttgactttcttcatgaccttgctcgctactgggctcacgcgggattgatggtattcttgttcttccttacgacgttatataaattccgactaataaatgataggctacccggcttgagcgattccgcaaatctgttgaaggaaagccactcctgagttacacacgaaaggaacatagtgggttgcttccagtagatgcaaagaccctatggcaaagcgtggattatgcgcttctttccacccctacacgcccagggagcccgagtctccaagcggaagcaatgcaaacctccgagttcgatttctcccccagtctgctctttgacttcccagtaccagattttggaggcatgcaaaatgtggacatgggcgactttgagggattgataagtctggacgaaggagatatcgttgcgtgatttgattttttgaaatgtctggacctcttctatagcttggatactggcgctgcgcttgtagaaatcatcttatttccaatttccctcaggatctccttccgaatcttcccacttcccgtgaccggatactgtgttatgctctcaccattgccgacccagaagactctaacgggggctttatgacggcccagtgtctcgcgaacccaggctttgagttcttcaagtgtaggttttgtttggttcggacgcaggtcgagaaatgcattaacggactcaccgtagcgatggtcttggagcccaacaacgctggcctggccaatagctgggtgatgcaggagcctctcttcgatttcgacaggataaatgttctcgccgcctatcagcaaggtcagtaatctataatgtttttttttgaaaaaggaaatagtggctagaacgagagcgggactcacccctgataatgatgtctttaatacgccccgtaatggttaggtagccgtgttcatcaatggctccctcgtctccggtgtgcatccacacagtaccgtcttcgtcctttatcatgacttcggcggtcttctcagggttttggaagtagccctgctgcacgtgccagccggcaacgcaaacctcacccctcgttccacgtgggactatcttgtttttgggatcaacaatctttgctgaaacatgaggcagagccgtgcccacagtctttaatttcctttcgaggctatcttcaactctgacgataaagctcgttggtgcagtctcggtcattcctactaggctgtcaacacttcatgttctgatacgagggaaaagaatacattttgcatagacccaccgtatgggctagcgatatgacggaaacctagtttctcgctcatttctaacagcattgcgcgtgggacttttgttccagcagcgaaacccttccggatagaattgaccgactgtccagtcttctccagctccttgatgactgcagtaaacattgttgggacaccgtgcaggacggtgcatcgttctttaagaaccattctcaccactgctgctgcgtcgaagtctggtgcagagtatatgatcgatgagccatgagtgaaggcggcgaggagacctgcgacgaggccgaaacagtggaaaagcggtgggccacagcacacaacgtcttctgggacaagctggaggtagtgtcccatgtagaagccattgttggcgatgttactagaaatatcaattgagagatttgtctttcagtttgaacgaatacatgagctcccacttacgagtgagtaagcattgccgcttttggggagcctgttgtgccactggtgaactggatgttgacggtagagtgtttatcaaccagtgcttgacgtttgttgagttccgaatcgctgatggaatgtgcggcactcaggatactgtcccacgtagatggtgggttggtggcggagagtgtatcccatcgggtcatcacgatgtgtttgaggccattctgaacctggctgagcttttcgaggataggagcagtcggccggcgatccacgacattggatacgaaaagtatcacagggtctgggacgcaaaattagcctgatgagatgggaatgaatagatattagtctggcagtcctcacctgtgtgctttagagctcgcaggcactccgggactgtgtatgttttattgataataaccagacaggcgccaatacgtgcagccgcaaagaatacctgtacgaagcgttcatcgtcaccagataagatagcgatacggtcaccgctttgcactcccagggctagcaatccacgagcaatgaccttgctgctctcgctcagctcccggtagctgaggcgcgtgttattccacccgatgacgatgcaatctttgtcttcatatttggctgcttgttgttctgccagttggccaatcgtcagatcgaacagggctggctcactcggtccgtggacgagggataaggccgggttggacatcttgtggcagatggagcgtatggtgacaaaacgacggaaagggtttctttttctgaaggaacaatgacttggacgaacgtaatattaggttcgcttaatgatttaagcaacagctccaatgtaaggcgatcagcctctatccacgaggtcgcatcccgactcttcgcacggcaacgatatgccgtgcggcccggctacaattccggtatcacccactgaggattgggcttttcacggatgtaataagttcacagacgaggaagaaaatatccctagcctacttttacgcctgaattgattgtgatgattcaacctgcactaatttctctatcagagacgaaaagctgttgcgcctacgtcatgtctccctctgctctggaaagtgcacccactggcttgaatagcgtcaagatatcaattccagagccgggtatccttttggtactgatcaatcgaccccgacagcttaatagcctaagtgttgaagccgggtacgagcttgactctgtattcaagtggttcgacaaagagactagcctgagagttgcaattttgtctggagtgggcaaagcgttttgtgtcggcgctgatctgaaaggtaaggctcctatcttacttttaggggcgtcactttcacggtagctgacaatacttgaagaatggatggaaaacaacaagaaaggggtgccgatgagcctgccggagactgggtttggtggtgtttcctttcgccatggtaaaaagccaatcattgcggcagtcaatggccctgcacttggaggtggctgtgagatggccgtcaactgcgatttggtggtcgcatcagcccatgccacctttggcctgcccgaggtcaagcgcggcgtcaccccttttggaggcgcgcttccacgaatcatgagaactgctggccgccagagagcgacagaactggctttgacgggacgtactgtaacagcgcaagaattcaaggagtggggagtttgcaaccgagtctgcgagaaaggaactgatgcagtagcagaggctcttgggatggccaagatgattgtcgagaatagtccggatgctgttattgtcacaagagaaggacttaagatgggatgggagtcacttggtgtcgctgacgcaagtagattattccttgatgggtggtctagaaagatctatgatactgagaatatgcaggagggattgaatgcgttcacagaaaagcgaaccccacaatggaaggacagcagattgtaagaaagctaatacagagtatggtagctggatataaaagacaattgcaacgagagcacattgtagaaggccgcttggtgaacgttcagcctttctcgtggtctatgctaacttctggtcttacattgtgtgaaaacaaggggctattttccatttaacgagagcaatatgaggatcagacaggtggtgagccaaggctaatgttcctcttcttgagccttgactcaagcagtctcaagccgcagcaagatcggcgtatcgaagtcgccatgcaggtgggcacggtgggcacggtaggcacggtagtatacagccggccatccacattgtccaggaaccgacctgccccaaaaggccatctacgcatcatattcaattagaggttgcacaaggaggagaaatgatagaataatccttaattacgtgttagccaatatgagtgagccgtggaaagatttcgagtttcccgcgagaaaagtgacgtggctgcagcgagatacactgttgttcaatctcagtatcggatgccgagctgacgaaccgcagtttgtttatgtgagctaccaaccctgccgcgtgcccaaaatgatgtgagtactaatttttggataggagggtgacccgaggtttgctgcttttccgacatacccattagggctaggtgctgctttcgatggtgtagtccagagcgatgtgctgaccaactgaacagttttcaaactagatcacagcgaagtcattaacttctacggaaccttgggatcaacgaatattccaggtgtacccaagcttgaccccagacgattggtggatggggatagagctgttgagatctacaagcctttgccaacaacatcacttggccatgaatttgagttccgctccaaggtgatcgccgtttatgacaaaggaaattcaggaactgtagtccggtccgaagattttttgatagacgttaaatctggggagcagtatgcgaagattatcggcagtttattctacgttgggcaaggaaactggggtgggccaagagggccaaggtctaacaaaaaggccgtgcctgatcgacataccgatctgattttcgaggtcgaaattggacaagaaagcgctcacttgtacaggtaatggaagaagcatggccaactaatatcgcctgtcctcggtgctgacctgagtagactgaatggggactataatccactccatgcagcttctgatgtgggaaaggagctgggctatggtggcatcataagccacggagtattggggtataataagattgcgcacgaaatagttcggcgactagggaatggcgatccatctagcatgctcaaaatctcagctaggtttgctggccctgtgcggcctggagacacactggccgttcacttgtggaagcaggatttagaagtggatggattggaagaagtccaatggtctgcacaggtcacaggaactggacaagaatgtctatgcgacggtacagctgtgataaagcccccacagatatcaagcaacatttaaaatcaacattattcgtttcgtgtgagcatacctatattgaaacataatcacgatctccctcagtactggaacagagcagaaatagcaaactacatggatatttttttatcatcgatagaaagtaaacagtatgctttgccaccatttcatgaaaccctagagactagagagacccctttcgtgcttcccagcccaatattctctatctcttagccacttcaccgtctgcgcgggtatgaaatagccgtgctagtatcctagtggtgcggtccaggttgtgatattttagcacaataggcttggcgcggggaaaatggtgttcgtggggccccagactggaaactggactcttgcctggcattggttcccccgtccgagtttgccttgtcgttgttgattagatgacacggtcattcggatcacatatataaggtgtatgaagctcagccctactgtatatgtgttgcccctctataaacacttgcatattgcaaaatcagcactcaagttagcatacgacaaccgatcaatcgttcaaaatggcagagaaacccagagctatcgatcacccagcttcagatcatgtagagaaaatgtctggcgatgttgaaataacacaaacagagacccttcaaatcgattccgtggaaatcagaaggctgcttcgaaagatcgatctccgactgctgccactcttaactgttctttatgttctgtctttcatgggtacgttgttcatagccgcaggtgttttagctctctacgattttgactaatccgagtagatcgctccaatattgggaatgctcgggtggcaggcatgaacacagacctcgctctcaccgggcctcagtacaacatggcccttacagttttcttctttccctatgccctttttgaagtgccgagcaatgtggtactcaagatgatgaggccttcacgatggatgtgcattctcgtcattatctggggcactgtaagcatcaagcaactcaatagataggaaggtatgagctgactggtgactatcacaggttctcactcttcaagggatcgtcaagacctatgaacaattattggttactagaatattccttggggttgcggaagctggctttttcccagcggctacatacatacttacgacttggtactgccgctgggaatatcaaacccgggttgctatctttttctcagcggcctccctagcgggaagcttctcaggccttctagcctttggaatccaacatatggaaggaattgctggccttggaggatggcgttggatctttattctcgaaggcatcttgacagtgcttattggtgtcataattccctgggcgctccccgattctcccgagacagcttcctttcttacacaagacgagaaaacgattctcatccatcggctgcggcaagacgccgggactcaggcacgggaagactcatcagaaaaattccaatggaaatactttcgtgctgctttcgtggattatcgaatttatcttggtgttatcatgtattggggcaacaggtgggtttagacacacctcggcacaagaaaacggttgagactgacggttcgattagtatctgtatctatgcattcagtttcgcagccccaaatatcattcggcagctgggatactctgcagccaatgctcaacttctcacaattcccatctatctggtgggggcgatcgcgacttatggtcttgccaagatctcagaccgacgcaaagctcgctggcccttcgttatcataccattctgcatctccggcgtagggcttatcgctctgttgtctatcccacaccctcgcttgccaggtttgacttatgccttcttattttgtattcccgctggtctctatccagctgtcattggttgcatatcatgggttagcaacaatcttgcgccttcctggaagcgagccattggaatggcctttttgatgacattgggcagctctggtggagcggttggagcaaacatattcttggacgagcaggcaccacgctacccgcttgcctacggtctctcacttggcgttgtagttgctggcatatgtgcagcgatggtgttacgcttcgctgtcgaccggaccaatgcgaagagagatgcgattcctgagtctgaaattagggccaagtacacagagggtaggttgttggcttcaccgcaagcccatcattttccgagttgctaatagatcttttcaacagaggaattgcacgagttgggagacagctctccaatgttcagatacgttaagtaattagggcacgggcggaacgtttcgcagttacgagctccaatgtgacctcgaggcctgtgagggattcacctagattggatagctgatggtcttcgatgatatgctgtattattcaataaaaccatttgtttttggataatgaaattcaacccagttacaaatgaatctactgaaactgctccaaaattccaattagtcacataatacatcttgaaggatttgaaaagttttaacgctgctaagtaagaactgtgctagtccagaagtacttcctataaaagaaatgaaggttgaaataacttttggttttacacccatgtatgtgttcctagttttgggagtacttagtagctagttgagctctacgtttgggtattaatctcgacctttggaaattttcttgtaaattgaagatattgtaggttattcataaatcttgacatttctatcttgatatttctgaggaacggatttgcactatcctccgtgcacttctacacggggagactgacaggcacgggtatcaaaagttgctatgatccgtccccacaccacggccgtaactcggaaagccgaggtataaaacctagattttggcaatcaattgtgaattgcaagctttttttcactaatatatagcctgtgcctcaaacatcaagactctcgtcgatagctcaatcatttgtgtcagcaaataatttttgaagatgggtgtcccgtacgctgatcctctctgggtatcaaggggccagagtccatactaccaagacaagcatgttgctttgagaaagaaagtcaggtcttttgttgatgagaatatcctcccatactgtgaggaatgggagacgagtggttcaattcctcaagaggtaggttacggaactaccttacgaccccttaagatgaaacgattctcacctggccaggtcatcacgaaatttgcagaaaacgggctcatggccgcctcagtattccctttggctactgagtatatggatgatatccagcttcctggaggaatcagccccttagaatgggatgagttttgcgatctaattgtgatggatgaaattgcacggtgcggctgtcttggagttatttgggggctcgcatgcggaaacatcatcggcctgcctcccgtgattcgattcggaacgccagaccagaagcgaaaatttattcctgatgttttaaaaggaaagactagattctgtctcggagtgactgagccggacgctggttccgatgtcgccggcatcaccactacagctactcggcaaggaaacaagtatgtgattaatggtgctaagaaatggattacaaatgccatctgggcggactactgcaccgcggctgtgaggaccggaggtccaggacaaaagggaatctctgcaatcgttattccgctgacctccgccgggataactcggaagagactgttcaactctggagtctcctctagtggtaagcaaacgcgtattactttctgacgtcgatattaaggatactaaagctatgccaggatctacttacattgaatttgacaatgttgaagtcccaatcgagaatcttattggagaagagaaccaaggctttcgaatcatcatgtcaagtatgacttctcacaatattatcctatatggacgcgagttaatactgatcttctctagatttcaaccatgaacgaacctggctttcttgtatggctttgcgtcttgcaagagtatgcattgaggactcatttatttacgcgtcaaggcgcgagacgtttggcaagaagctcctttccaatcaaatcattagggccaaactggcaactttagggcgtgagctggaggcgggccaagcctatcttgagcaattggtctatatcttggcccaatcactgaggacaactggagtagaacctacgggcattggcggtctcctggcaagctcaaaagtgctttcgtgcagagtgctagagcacgctgttcgcgaagcccagcagataatgggaggtgttggttattcgaaggggggtaggggcggacgggttgagcaaatcagccgcgatgttcgttgcatggtagttggcggtggaagcgaagagattttgacagagctttctctaaaccaggagatgaaagctttgggcagcaagctgtaattaatagtttggttaacgctagcatcaactaatgaatgaacgcctagcagcgaattaaaggctagaatcatataaaagcataaatatcaagatatctttgagagtgttgctctatattcacgagggtggaatcgctctcagttcagtatcctcacttaacttctttctcaagctgccagcatgcacacaagtgtccgtcatgtgagaaatatcaggcgtccagcagatgatttccagaagccgcagatactctataaatatattgagattgaaaatggaatggagataagaccaaagtcccttaaaatatatatgagtactaacttctctactgacaatgtgaacatgggttctgatttacagtctggccaggcccttctgtgtctgagccccttcaataggatctaaattaacaacgttcaagcagatacccaacacctctcttgtgtctcttggatcaattatcccatcatccagaagattagcactggtgtagtatgcctgactctccttctccaccttttgccgaaacttttcaatgccagccttatatgatgaagaaggggccttggccgccttccctagattcttcttcgctgcgcttccggactgcacaatatccataacccctgcgagttggtccggtcccatcacactacaccttccagacggccaggtaaacataaaccggggctgataggctctgccacacatagcatagtttccggcaccatacgaagatcccaaaatgatggatatctgaggtacttgagagcaactcacagctgccacaaactgggcacctttcttgataatagcttctctttccgctttggagcctaccataaatccggtcacgttgtgtagatagatgattggaatatttctgaaatagaaatcagttgtgaatgaatcacggcaaagagaatatcgtcaggctcgcatacccttgattacaaagccggatgaactgagcgccttttgaagcttcatctgggtggatgacaggggtttgattcccaattataccaactcgaaagcctataatcagttaataattagcacctcagatattcgaggcgccctgggattcatgggctggtccactcaccatggatttcggcccagcaagtgagaaggtttttcccgtaggatggtttaaatactgatacccgtgaatcgtcaactatgcgaaggacaacctctgccatatcaaatggcttgcggatgtcggtgttgacaagagcaagaaggtcttcggctggatacctcggctcgagaggctgcgcacagaaagaagaatataaattctgcggcttcagagattgaacccatagtcgagccttgcggatagcatcaaacctagcaagttagttaatggatggtattttatctcaagaattattttctctctccgacttcttggattggacttactcgtcaaaggctatctgatctgcaaggccagtgacggtggcgtgcatatcggctccgccgagcgtctctgcatcgacaacctctccagtagccattttgactaaaggtggcccaccaagaaatacttgagcctgctttttgacaaatattgtgtagtcggagagaccaggaaggtaagcgccgccagccgtggaggaaccaaagacaacgctgcaagatggaatacccctctgacttctcctcgagagatctcgaaacatttctcctgctctatggaaaacacggaactgctgagggagatatgcaccagcctatggttcttatgtaagaaggtgatgcctcgaagcacgcaggacctgtttgcaatgctactcacggcttgtaccaacccgataagtggtaacttgttctccgttgcaatttgtgtaacgcggttgtgcttgagaactgaatccggtcagtattgtaaaccgcgatgtgcgcatatttccataaagttaactcactggtgaactcattccaggatccccccttgattgatgggatatgagacaagatcatgcacacttgcccactgatgttaaaattagcaagaagtctcttgaagcgaggggagtaaaacgagactacattacctgacttttcctatcccagctatcagactggcacagggcgtggaatcaagttcaaagcctgcgaacgaggctagctccaggaatggggagtcatgatccaggagtagagaaatacggtcacgagctggatcgattgattagtagagtgcgtcttgtatcatagtgtttcaccgtaaggctgggggttattactgaccaagaagctgtccgcgctcattgtgaatccgctgcgaccgttcatcaccctctgaggtaacatcttgtagagctttctggaacctctcaagcacaggctgccatgacttcctgttctcgttaaaaagaggttgctttaggtcaagtttggccgtaacaacgggtaggggggttgtagacgccattatggtggacaacagtgatattggatctgatttagtcgtggaggacaagcggttagctcaaagaaaatgcgagaggaaacctattccaaatcatggcacagtctatccgaagtctcatttggtaatatccaaggggctttatttgggaccgaggtaaagaggctacatgatggtgtgctacgactagcttctttggatggttgtctgtaacccggctaatgaaaccgggtttgccgtgctgtctccgttgtccccagagcactcgcatacccggccctcccttattggcgatcaatgacatgactaaacctttctacagcttggatcctattgcccgatgattcaaactgtcccaatctgtggatcgcttccccgactggaagttgcggagtccaacagcagactctgaatctgggcccatcatgtttttgaacaccttgtagattgcagcatcctgctcagccgtgccgcctcgcagccaggcttcttgggccaactctttgcacatcttggacgcaccaggggcgcagttgctcaaattgaccagatactcgtctaagagcacattgagtgcaacttcatcatctgcaagaccgtgcacggcaccgatttgcttcaactcggccatggaaatttccctgcctgacagcatggcctctcgtgtgaatgcaagaccccattctcgcacaagatacttggagatgattgctgggcataggccaagtctgacctcactcagcgccatcgtggcattggcagttgccagacgaatgtcgctagaaaatgccagcccaattcctccggcgtaacacatcccgttgatggctgcgattgtgaccttgggggagtcttggatggtctgaaagagtgtagtgaattgttcaaatgccccagaggccgattcttcgcccttgccaaccgccgtagtcgattttccaagatccattcccgtgcagaagaattttccctgggcagttaggacgattcgagagatactgtcatcgttggttgcttcttgatagcattccttgatttgggtgagcatggacgcgctcagagcatttccgttcttggatcttctgaggacaatcttgagattcttgcccgacttatagatcccaatgtcgccttcgctttgcaacggcgtccaaacgagcttaggggatgtttgaggcatgttataaaacttgattgacttcagatgccactattaagtgtgcattggttggaacaatgccgtaggaggagacttgaaataaccggtgattgtatgtgcgtatcaatgctggaatgaaataagaggtacgcagattcagtgtaattgccatggctatccgtcgctcgtcagacgagaaaggtgagactctgcggtagtacccggcttagatggtcggtggttgtggggacggatgagacggtaattgagcaactcgactgcttctagcatgtgctgtgacctatgacatttaatgagattggtcatatacaatatttcgaaaaccctagcgataagtgtgggatccggttgattctggttacgttaactttcaatcaaggttctcgatttgttctgttcacctccccaagcactccttaatttgtgaaaagctgccgaaactaagaatcgggcaatgacgacggacggaagctcctcgagaccgcctctttggacggcgcaattgccagtctcaaatgacggcatccatagaatctctcggattctgatcgctaatcgtggagaaattgcttgtcgcatcatcaaaacatgtcgtctgatggggattaccagcatcgccatctacacaaaagagtatgtacattgattcaacgggctgctgagagccgaggcacaatgattgagccaggctgaccataaagctagagatacaacatcaagacacgtgtctggtgctgatgaagctatcaatcttggctctgtcgagcacgctcaggtcaatccttttctggacatctcctacctgattcaaatcgccaagcaggctcgagcggatgccattcatccaggatatggctaccttagcgagaattcgcaatttgcagatgctgttcgtgaatcaggaatggtcttcattggtcctagctcgactgcaatgtcaactcttggggataagagacaggctaagcaatacctgagcaagaatgaacccgggataccactgatccccggctggaatgggtctggcgacgaaatggacattaatcaactagagaaggaagcggaggctattggctacccggttatgatcaaggcatcagccggaggaggcggaaagggcatgcggatcgtccacagcagttctctattgaagagcgaattagaacgcgcccagtccgaggctaagcgctcctttggatccagcgagtgcattctggagaagtatatcgaggctggtaagcacgtcgaagtacagataatgggcgacaagacagggaaggttctctctctctgggaacgcgactgctctgtccaacgtcgacatcagaaagttatcgaagagagtccctgcgcatggctggctcccgaacttcgcaagaaaatgtgcgacacagcagtgaaaattggcgaactactcaagtatgagggcgcaggaacagttgaatttatcttggatattgtcacggggaatttctattttctcgaagtcaatgcccggcttcaggtcgaacaccccatcacggaggagtgcactggccttgatctagtttccctccagatctacgtggcctcggggggtgagttgagcaaggtaccacagctaaatactattcctcagactggtcatgccatcgagtgtcgattgtgcgcggaagatcctattcgcgatttcgcaccccaacatggccttgtgcgattctgggaaccggccactccggaccatccaagagatgttcgatttgagaccgccatcgaaactggaaccagggtctcaatattctttgactcgatgattgccaaaattgttgtctgggcccctacgagggatttggcgatcaagaagatggtccgaaccctctcagaaaccgcttgtataggactttctacaaaccagtgctttttgcaagcttgtctcatgcatgaaaagtttcacagcgttgattacacaacggcgttcatcccttccaaccttgaccggcttcttgaaaacccacatctgaagtatttcggcttgtcactacaagagttctctgccattccgagtatgtttattcgtgagctaaagtctcagagtaaactcgaacaatccagaaaagtctttgggagtatccgaaggggctttcgcaaccagaccttggacagggtcaatgtaccatgggacattgtcacacgctatgactcaaaggccggatctaccgttgaatctactgtatgccgttggcttcaggagtcacagattccctcttctgatggattgcgtgttcaggtggctccaatgccgcccccaaagactagagacgaagacgcagaggccaatgggccggaggaagccactatcgcgtacaacacgttgagtgccgcacttcgaagaggcgcgttgcctgcctcgaaacaacttgatctacagcttcatgagctacgctttttctcggctggactagatacggcggacacttggaaggttggctgcctgcgcctatcggcctcggggcagaaatatgccgtcacccttgtatcggtagatgatcgagcgctccatttcgagtctgacatgggaacccctaacaagattcttgcgcacattcctgctctgggggcgccattcgagtttcattgttactctcccctatcgtattatgaaagcctcagagcctctgctagtggagggcgagaggcaagctccaagactattcttgcaccgatgccctgcaaagtgttgcgcgtggaaaagaagaacggcgaggaggttaagacgggcgaagtagtcatggttgtggagagcatgaagatggagatcacaataactgctgggagggatggtgccttctacacaactctgaaggagggggattcggctgatgaagggtctcttctttgtaacttagaataattgcatattcacatactgggaatattacacggtgttctggctgcattatttacatacaggcaatacatagtcttgcaccccttgtatcttccctttctcttaatcctgttttccaacatctcttaaaataaagattgaaggcaattggtagcgaggtatattcgattccaatgttgatcccaacggaatgtagtagtaaggttagatcttgcacaatcgcgagctatgactactacacgtcctcgagacatcaacaaaatgtgtgttactataccaagtataactggactaggaagatgcgcagtacctcggatgtgaacaaaaacagaccaaggcttactgaaggcggcttgccacggccgaggcgagaacggtactgtattgccgtccccacccaccgccggctgagcgaaacattgagtatcgcttgtggtcatacgcacgtacttggtaaaagctattgggctatgccaattttattgcatccttgaggctattatcctagaatccatcgcatattgtctttttgaagctcgctagaatgaaacaagttaagattgggtgctataggtacgacctgagatcaaccctttcttccaggcgaagctgactcaaaaatagtgccttttggggcgattctgcctcagccgtgaagcagttccttgaaaatgaagaaccgaaacttgactacctcgttgctgactacctagccggtgagtgctcagcgacatgcttgtggaattaatgctaattacaactctcgtatagagttgacgatgggtctgttagctcgttcagttgcagcatctaataagggctacatatctgagttcttggacttggttctggcaccataccttgacttcatcctgaagaaaggcgttaaaattgtcaccaacgcgggggggttagacccagtcggcttaaaacagacgattgatgagtataccaaatcgagaggacttgagtcacgagtcaaagtcgcagctgtatatggtgacaatattctctctgatttcggaaagttggcagaacaagatgccttcacacaattcgaccctctcagtggagcgagctcacctgaagctggacttgatagggccgataatctgttgagcttgaatgcttacattggcgctgagccaatcaccgaagcactaaagcagggagcaaatatcgttgtgacgggtagatgtgtggatagtgcacttgttctcggacccctggcattcgagtacggatggcagtacgagatgactcagactgatctagaccatctagcgagtgcatccctcgcaggacatgtgattgaatgcggagctcaagccactggcgggaattctacagattggagactttcagcattcagtcccaatggcggatggtccaacatgggatatccaatcctcactttcactgaagacaacacgttctctatcacgaaaccagaaaagactggaggggtggtctcccgggcaagcgtggtcgaacaaatgctatatgaagttcttgacccagagaactacgctctacctgatgtcgtcgtagatatgagccacgttcaggtcaacctaattgagccaggtcacgttttggtgcgtggcgccaaaggaaagccaccaagtccctggctgaagtgtacggcagtgcaacagagagggcaccgcatcgccgttgacttcttggtgtgcggtgacgaagccgaagacaaagccagatgcctgggggccgccctcattgatagaaccaacacgatcgcagcccaacaattacccggcacattgaacccaatcagctcttcagattcgggaatcaacattattggcaatgagtccagcctgggtcctgcggcaagtcaggagaaacgaagggaagttgtgctacgggtgtcggcccgacactccaaccgaaaggttttggatatcctcagtaaagaggcagcttcgttccttacgaacagctgccccggtgtttgccttctcacgtccggccgagcgaaaagcagtcccaacttcgtcgccagcagtatacttatcaaccgatgcaaggtaaatcctcaaatttatgttgatactccgaaccctgtctcggtgtctttcagaactcaagggtgccggcccatcgaggctgccaaaactcgcttacacgccagttctaaacccaagacctttccacagacgggtcacaaactggtgcagctgcaccaacttgcgattgcaaggtccggcgataagggtgatactgctaacatagccataattgcccgagatccaaatcattaccagcatttagtgcagaaattgagccctgaattggtctttgcccagtttagtcattttattgctgccgggggacaagtgacacggttcgaagtgcctggagtttcagcgctcaactttgtgctcacccaatctctgggcggtggcggtctttcaagcctacggctagataggtatgttttcttttccactctaggcttatggggagatgtatgaatggtagttttaacatttcgcagacaagccaaaacatatgggcagcttcttcttgccggaataactcttgaggcaccctctgcatcatccagaataatgtcaaacctatgagcatccgaatttgatacgatagtcagaaaagttaagatcaccatcttatatttttatcgttgaatttttctagtaaagctattgatggtggaatgttgtcaacaattcaatctgggtttcgccgttttcgcaaggacttgacgccgtcaaatttggatatcgtgactcgggaaggtttggcataaccagttcactcatcttactacacattacttccatagtgactaagaagaaaattcagttatagctatagccagcttagccactttcattaaagatttcatctttccggtaaaattcgactaatcctagtgtatgtatcataggaactccgaggaaaggttagagactggaagccgatgaagtctaaaagatcaccatctaagtatatctagaacacgggctaagggccgcggctgagccggcatccttagggatgactcccgcttcaacagccttcttgtagcaccaacgccagtcctcaactccatcacacttccaggtccagaagatccagccattggagcgctcaaatgactcggcctgcgccgcccagtatgcgcgataccatgtctcttgaccctggtatttgaattcgggtgtgttcttcagtgtgctattcaccgaaagcgaccactcacccaccgtcacgttggtgcccatgttatccttgcaagcctgcgtgatgtaggctttctttgtaccctcgatgcggttgtcaaagcttaggtagcggtgggcgtcgaagaaagccatctcggtgctgggcaggaactctcttggatcgccggatccccaacttgtgccctgtggtttctgttaattaaaatggaccaacaggtagcagaaccaaggtggaaggactcaccatgaactgaatgtggaggcggtctgccttggcaacgttgagcttagcctcggcggcctggatgcgctcgtatgcctttggatagaaattcttgcgcatatcggtggcattaactccgcctcgaacaggttcgtttaaaacttgtagcataccgacagttgtatagttgccattcgtatggatacggttggtcatccactcgaggaacttgagtgctcgctcatagttggcagaagtgtagaactgtgggggattcacgccctggtaatgaatctattagcgagaagtgtacaatcgacaaacaagataagggtttcttacatggccagtgaactcctcattcggcgactgcgatccaggggcaccgtggagatcaatgatggcatagacaccatacttcttgcaccacccgacaatacggtcaagataggggaggcccccgcgggggtaatactcgtttgcataaacaaggctctctcgcatccagaagccgacgggaatgcgcacggtattcaggccaatctccttaatctgcttgatatcggcctcggtaatccacgtgttccagtgatttttccagacctcgtcagccttggcctgaccgagggccttgacgcaattccactcgtcgtaccagccgtagcagcccatgttcttccagctatccttcgtaaaccactcctcgatgatgaactgggagccgaggtttacaccgcggaccttgctcgccttgggcagccagcgctctgtcagggagcttccatcctcggggataagctctggatcgtactattagcatcggcgcaatagatacttgggtaggatgaaggaatgactagcacatacctctgctatccaaggtccaggcttgggccatagccacaagcaaagacaaagcgactttggtcagaatcatgatgacggaaacaagtctatggtagaacgaagtcggttgggtccgttgaagaatctgaagccgcaagatggacgattggcgaggcaatatataaagaactggcaacggctgagaagatctggctcgcagcaacagatccatgttgacgtagtgcccatcatgcccagatgcgtcgaacggttccacacattctcgttctggaaatacgtcaaaggccatgcatgatgctcaatcctgcgcctgagatggggccaacttgaaacgcggaacggtcatcctggacaggcggccaactttccgtccttgctggcgtgatctaaaataaattccgttgcgatcaccatgatttaaggttgtcagctgtcctgtagccatgaggtctgcctgtaattagacatgtcgcactttagatgagacaatccagtagatccttgtgcagttcctgcgcccagtcttatagaatataactacaagagtacaacgagatgcgtaatgtttatgtctagagtttgtgaatgcaataaattctcatgaatcgggtagatctagcgatgaagatctaggagcacatcaccatcgactgcgagctggtggcactctcagctaaaaccggctgcgcccgtcgtgccgcatttgtggggttgcaatctcattccatggccagcatcgacaacagggtaaaaacgggttgctcgtaagacgacccgaggactggtgaaacgtagcgttatgcaaggagatcaaggctgactcttgtcactaattgccggatcagtcgggccctgccaccttattccacaaaaacacatgcgggattccgcctcgatcaagacatgcgtttataccgttgcattgagaggcagaaaaagttcgctcggccccgcctattttcacggtttgcctttgacagctcccatgacgatgcatggatgagttgtcatgccatcataaaattggctttcccctccctctactcggaaaaaatcaagtgagtgggttcagtggaactagccagagtatcccaagaagccaacttaatcttattggcattacagcttgtatacaaaataactttatttgctcttctcacataaaggctacctacccacagtccagttattgctccatccattttttatcacaagcaggatatttctcacaccgattaccggcaataacatcacacgggctgaaaactcggccaccacttccaagtatggcatacaaaatattgcagaacactatgccacataccaaagaatcttattccctataatttgaactactaaagccatctaccacctcactaggatttggaatttaacacttccctgtttccactcctatagaatcattctaaaaactcttactccaaccaagtcgttgtaccgttagggtgagacaccaactcaatattctcagatgcatcctggatggattcgctcttgcttattaggcttcgaggacactagctagagagatccagataaaggcttctcgccaaggcgtatcctggccgttgtcttcaacagttcactgagaaacccctttgttatttccaggttcttagttcgaaatgcgaaacagccagcgctcaaaagcctcatcatcagcttctacaaacttctccttcttcgtatttttccacttcgaagaacatgccatgaagctgctatgatttgaagggtttgtcgcaagcatcttgaccttcttcgcctcgggcgtttcgccgccctcgcacatgagcctcgcttgatacgatttttccgcaaaaatacttgccctcgctttgtcaccgtgcgcgatgctaatttgaaaggcatcgtaataaagtcgcgcagcgagagccccaggataacccctatattcagcttttaggagttgcaggagcgaatggcaatctttgaggctttcccctggactcttccacatccgaaaagggtctccaatctgaccatcgagttgttggattcgtgaacgacgagtgtcgctttctcgtagcagggcctctggctgcgaacaaacaacacagctacactggaagccaaacgactgcttcaaagaagcttgccggaccgcacatgggccgcctttgtcatatgagattgtaatctcttctccgcatttgattggactaatggcgaaaatagtttcgactttggtgtcactattccatgtattttggctgttggggaggcagctgtgattgatgcggcatatcgtaggataaacagccccgatctcagacccagaaccacacggcagagcattcgtcttcataatgccagcaaaaggatgctttccggggaagttgttatggagtgacaaaaattgcctctggcttgctttgttcagctttttgagctctgacgacaagaaagcctctagtgcagcaggtgctccaggtcgagtgactaatagcggcttctcttggataattagagtcccttgagatatgtcctggagggctaccaggcctatccctttcagcggaatagtcttggcctcgaacataagtggctcgtcgagctggtatatcttattagctacaatgcaagagatagtagagggtgcaagcagcaaacctgttcaagggagctgttctgctccttcgaggcagtattagagtccatgctgccgaatacttgcaaattgacgacaagaaccggacaatacaacagcttggatcacttcaaggcccttttcaatggccaaggctttccttgtcgaaggttgaatgtagacaagtcaagtcaaggatgcaagtagaaccaaggtatgcaatcaagatctgggtaatcacaacaattaagtacaattaagtaggacagcgcaaggagacttgttccaacaccagaaatgtaggggcgactcgtcgtgctatttttccaacgtacctctcctcactgcacgtgtctgcgtttgattcgatcaattagttgtttgcgttggttggcctcctgcatgatgactgtgtgcgtcgcaccctcttgatgtctcaattactagtgcagcattgaacattcagatcgtacttcaagtgtacgacatatacatacaataaaaggttaagatcccttttattaatcgtctgataaaatatatgagaacgtgaagctctagaatacttattggcaaatcttactgtgcgtggcggcgaaacatatgaaatcataaagacaaagtagaagattgagtgccaccggaaagatcatctggcttatcaaactcatctcaatggccgccatatagccgtactagtgcgtaacacgatcaggcttggatacgatctgcgtaaagacagagatgctattataatagggttttataggctgccgggggataataccagcgatttccagcaagaggaggaagtgtgatctcactagcttttgatattgattctgaatatagtcgatcactaccagctagcaaaagattttcaaacgagctaagaactccatattcatcccgtggccttgttcattcatgaaatcgagcgccctcgctcgaagaatatcttgccgtcgaggaaaggctcaatgtctgagaccctcttcgatatcgctcacttctgtgcattgcgatgctccacctgttctgcttcttccaaggtatccgccatcttcgcttgggtcttatcaagatcggcgacaacaacctcgtctccaaagatctcggcaatctcttcaagcgacttgcccttggtctcagggaagagaaggtaaacaacgatggcgcctacaaggttggtgcagatgaagagcgaatagtacttgtagccaacctgcttgaaggcaattggggagacttggttgaacacgatgttgatgaggacgttggacacgacggaaattgcagagccctttagcaaaaacaactatcagcttatgctcaacaatacaactttcggtcaagtacttaccttggcacgaactgccatggtcatgatttcaggaacgtaaatgtaatggatcgagttgtaacccagagagtagctgaaagttcgcagtcagtaagtgggaacagactgtacgtggggttggagtcttacattgcagtgaagcagaagatgaaagcgatcgtaaagcctttcgcgaccatgttttgagaagacccatagccaccagatagacccatgacgagacccatgtcaagagccatgataagaccggtaatccaaagcgtcttacggcgtccccaggtatcaacatagtaaagacaaatcacattggcaatagggccaactaagccgtaaattctgggaagagaattccaattaggtcaacaaataccacagccgatcgggaaaataaacaaacttaccctgccagaagtgtgggcatgtgacccgtcattcccaagcccttgtacaggtctgtctggaagtagttgacgacgttgataccactcatctgcgtgaaaacctgaacaagcacggcaagcatgactctcttcctgtttccagcagtgctgaaaacctcgcgccaaccggccttggtaaccgtcttttcgtagcgaatttgctcccgcatctggttgtattcagcgaggaagaagctgtcatcatggccgatgttgccgtgcaggcgtcggataacaaccagggcctcatcgtcgcggtcatgctcgagcagccatcgtggggagtagggaaggaaatagatgccgaacataacaataagggccgggagacactggaaagccaacgggaagcgccattggaactgaccagaagcatacgagcacccaaacccaacccactacaaatatcaagtcagctcaaaaactcatattcagggcaacggggagagaggcggtatccgactgacattggcagcagcaaaaccaaaaccaacaaactgagcatgtagacctgcgatcataccacgcttttccggaggcgaaatctcagaattgtaaatcgggatcgtcatgttcatcataccgacggcaaaccctcccacgatacgcccagcaatcagcatacctatgtgaacggaggcggcctggatgatgccggcaatcagggcaatgacagatgcgatggcgatggtcttcttacggccgaggtagtctgcgctccatcctgcaaagaatacaccaaaaactgcgccgccattgaatgtgctgacgacagcacccttgatatcggccgtgaagggatgaaaatactcgctaaaatgctcctgtgcaattacagtggtaatgacaccagagtcgataccgtatctagatgaggaggttggtgagttataagaacaaagcggaggtttggagacgaggtttcacgtacaacaatgatccgacctatttaatgtttcgagataagctgatgttcgaggatggcataagcattggggtgggagctacttaccgccgcaaaaagggcgcatccccaagtgtaccagttcactgattgtttcgccgccattgcgaacgatgtctccaatgctccaaaccgaaatctaggcgaatgattggactagtctatcgactgtggaatccgtgacttagagaaacgaggatcaccaagtgtcgaggccgtctcctatttattgtgtgaacgtcgatactaagctattggggggtctttaccccgtggttgaaaccagggaggaaccccgatgacttggctggcattctcggatatcctccggacgtaaccgtaggtaatgccatgcttactccctggggaatacccggccaggctctgactaccatctgacctctattcttgtgacaaatcgaacgctaacactcaggctaaattcccagcccatggatatggataacttaaagcttttttatctggtcccagcagaacggtcgttgggatccagcatcgagtagagatcgatgccccggttgtcgtgacagggccttcccacaaagcgcttttccgaggtggggattctgctcatatttggggatcaggagagttttgttatttagcctaaatgccccagacaatttccatattccctactggtcagcctccgtatctactgggtcggcagttaggaaacatgggaggtaggcgagttctcaccgttggccgccaagaggtcctaacgggaataccgtatataaaaagaggctgaaggtggagctggcggagtgaactcctgttgctagtccctttcaactcttctccaaaaccccccaacacacaactgaatcatcgtgtcaagtttccgtttgctcgctttaaccttcacgtcaaagatctaggggaagagctcattcagcatccacgtgggagtaacttgccccgacgaaccccaaacatcatccctgagcaagtgtccacaagcggggttctcatcctgcctgtcaaggataagtaattgccactagtgtggtcattagattggtctcgcgcgcgcgacttccgactttaccctcggatataacggaagtttagtctggctgaagttcttctccaccgtcgtgtccacaagtctgtcagacagcctcaagtcgaagcaatcggtgggggtcaatacctgtggacctgagtccttgcgatacattatcttacggcttcaaaacgttgctggccgctcgtgtttctgggagactcaggggcagtgaacataccgagatagatagtcgttttcacatccagcatggttaagttctcacacggctgctggcacccagcgccagacactatcatcgattgggccgtcgaggtagtcaagggggttgcaaacgaggataatctacatttcgtcaccgtaagtattctctctgcatctttgaaagcatgggatttcaaatagcgatgaatgggtgatatgtttggatagctaacagtcgatacagtgctccaagccaatcaaccatcggggggataccctgaacaaccccacgttgacacaccatgtcagctcccccattgatgacgttctctacctgtcttcaacccactggaagggtcagaagagcgttaccgcgggtcctcactttgagctttacccagaagaacagcccgaccacagtcaggctatcaagacatcgaaaagtgatgacgagctaaagttctctgtcggagacctctcggcgtccgtcaacacgaccccaaagagcttcaacttggacttcaagaatggttcgagaaagttgacatcacttggatggcgttcaatcggctatgtcaagcaaaacaccactgccttgcacccgaaggcaaactacaccaaccccaacaagggagagagatggacgacctaccagctttccctgggtgttggagaaaagatttacgggctgggagaacgattcggtcctttcatcaagaatggccaaactgtcgacctctggaatgatgatggtggcactggctccgaactcacctacaagaacattccattcttcctcagctctgctggatatggcgtgtttatccccacatccagtcttgtttcactggaagttcagtctgagcgcacgactcgcgtcaacattgctgttccgggcgaatctctttctatataccttatttacgggcctagtcccaaggacattatcaacaaatacggcattctcactggtcgccccgctcttccgccggcgtggacctttggcctctggcttacaaccagtttcacgaccaactatgatgaaaacacggttaatactttcttggatggtatgaaggagagagatatccctgtcactgtgttccactacgactgtttctggatgaagggcttccagtggtgcgatttcgagttcgatcaagactttttccccgatgctgccggacagctgaagcgtatgaaggaccgcggtcaacacgtaagcagaagctcccaaatctggaagagagtagttctagagcggctactaacccctggtgactagatttgcgtttggatcaacccatacattgctcaggagagcaaactcttcgacgaaggtgccgagaagggatactttgtcaagcgtggagatggtagcgtttggcaatatgatttctgggtatgatgatcccatccgactttaacccctgggtttcgtggacctttatggaggctaatccgaatcatttttacagcaagctggaatggcattcgtagatttcaccaaccccgatgcctgcaagtggtaccaggacaagctccaagctcttgtcgatatgggagtcgagtcattcaagacagatttcggcgagcgcattcccacaggtgataccgtctatttcgacggatccgacccaaagaagatgcacaattactacgcctatctttacaacaaggttacctttgaggttcttgagaagtcgttgggcaagaacaacgctgcgctttttgcccgctcagcaactgctggatgccaggtactttacctcttcctagcctttaatactgactgatgaactaaccgttttcccgatcagagattcccagttcactggggaggcgacccttactcgacatttcctgccatggccgagacgctgcgcggaggtctatcccttgccctgagcggcttcggctactgggcacacgacatcggtggatttgagggaaatccagacccggcactcttcaagcgctggatcgcattcgggcttttctcatcccactcccgactgcatggaagtggatcattccgagttccctggctcgttgacccgaccgaggaggcatcgcgtgtgctcactcatttcgtgtcatggaagcacaggctgatgccgtacctctactcccaagccattgcgacccatcagtcgggcatctcaatgctccgcagcatgcttgtcgagttcccagaagaccctatcgcatggcacctcgacacgcagtaccttcttgggtcttctctcctcgtggcacccgtcttcaatgaagagaatgacgtgacgtactacctaccaaagggcaagtggtacggacttcttgacggcaagatcagggaagggccgggatatgtcacagagcagcatgactttttcagcctaccagtacttctacgaccaggcaaggctgttgttctaggtaactcggacctagcaaaagagaaggtcgtgtacgattggtccgacaatgttaccattgttgtcaacccagttgagggtatggccgaggtcgtggagattcccgaccatgagaactttggtcagatcaaggccaaggtctcaatcaaatctcaagggggcgccgtgaagctctcactcgtggaaggccagctcaattcaagcgccaaggtgcaggttgcggggggtgagatcaacgaagtaaaactctctgaacaagagaccgtcgtcaacgcataggtacaaattactgctatagaataaatccttatccaatccgatcacaaacaaaaccgtcggcgagttttgcgaagcccatgacgagtatatacacgatgatacttctgggtttgatccctgtccacctcttccaaggctaccacttatcaaggtgttatctttgacgcggggagcgcaaatctgattgggcttacctatgcagaaatacgggtctatcaaaataaaatgggtcagggcgggcgaattacctatttgaggaaattcagtagatggctgctgactaaagcttattaagagatctttgtccacttttttgggctcatcccaatttactcttttctcccaaaattaacggaagtgagcaatcgtgtaggtatgtttgatatggatcaagtctacacgtactaaatgtaagaaactacaatacttttcatttacttctaacttcagttctatgaatataatttgagttgtcgataccctaaaaagttcgaacacactaacacgtatgtgaccgtaccaccagaaagagcagagcatcctatctgctcgtcacgcactaagttaataccgtgccaattagcaaattggttggcgatggccaaaagttacccgctgtcgtaggttactttttttgcatgtagattaaaagaatagagatgacaagatgacagtgatggcaaacgcttgtgaggtcgctagaggtgagcaaaggtctagggtaggttggatgcagagccagcataacaatagcagcatcgattgagcagccggaatagcggtaaaggcttgaaattgaagatagttgcctacctaaattggtcgatgctcatgacccctcaatctgcatttccattaaacttaccatcgtctcttgttgtttatccccccctttcatgctactggctactcgactaggtagtgttatagcgtagcacatagccagcttgcataccaatgttctagagcatctccgtgagtccgcgcttcgcttagtttccgtgcgagtcgtgaggtccatagaactccgagactccgtgattccggccagtgacaaggatcaccaccggaatcctgctccagtgacgccatagaatgtcatcgcagcaaaacatcaattttaacagcttgggtatataatgaaatgaggggacactgattgaacattgaatattacaagattcaaaatcaattcgctctaccgtctgtctctctaccagcctcttctcagcccacatcaatattttccaaaacacaacatcccaatctctcaaaatggcacccaagatccttgttgttctcaccagccatagcctgattgagtcaatcaacaagcctactggctggttcctggttcgtcgcaatcgccctagatactagaaatgtacgaccactgaccaaagattgaaatagcccgagttctcccacccctacgatgttctcgcacccaaggccgagatcgtcgtcgcttcgccaaagggtggtgtcgcccctctcgaccccgcctcaatcgaattctccaagtccgatgacgccgcccagaacttctacaagaccaagtctgagatctgggagaagaccaggcccatcaaggagttccttggtaaggcggacgagtacgacgccctcttctaccccggcggccacggccccgtgttcgacctcgccaccgacatcgagtcgatccagctcatcatccagttcctcgacgccggcaagcccgtcgccgccgtctgccacggtcccgccgccttcgccaatgtcgtgggcaaggatggaaaccacgtcctcaagggcaagaccgtgacgggcttcaccaatgccgaggaggacatcatgcagctgacgagcgcgatgcccttcctgcttgaggatgcgctcatcaaggctggggccacctttgtcaaggctgacgagccttggggcgagaaggttgtgactgatggactcatcattactggccagaacccggcctctgcgggtggtgttggcaaggctcttgctacggctctcggtgagtagattttgcttctttcgtaattttgttcaattgatctaacattcttttgcaggtctgtgaatggaaatttagttttataccaaagcgtgctgtttgttcgaggtgaaatggttataatgagggaaagcaaggccaggctggaacaagtaatagaaatcaatggaatgcattgcataccttgtccattttaatcccagtgatgcgcacgttctatgacgaagataagacccagacgattggcgattgcgtttcaattttgtgtgctgatctagctcgaaaaggtccccaaccaaacatccattgtcaagactgctttcagccccccatgcagagaagttgctgctatgacagcatctctcgaagactttaggtagctatttagccttggattctggacatgagcttcaacgtcttcaagaaaaccatcactgtgcacagtgcccacttcccagaacccgtcttgcagcccaggctgaggaacgaggaggccttcatgctcaaggttccagctagaagccttcccgacagtcttgatggcgtctggagtgagaatgttttggacattctcgtcgctctccggtctctggctctcaagtgcagctcgagcgaggacggcaagaacatgaggcacagcagccggtgcagtagctgtcagagcatactcggcgatgcaaatcttctttacacgcttagataaagcacgaaagattttcccaagctcctcgggagacttgaaataccagatgcagtgggctaatactgccacgtcccaggacaggccctcgcccgctgtctggctgaggtactgctctggcgtggcctggtgccagttgatccggctgccgacctcgctgtcggtaatccattcatatgcctgacctagggtgacaggcgcaccatagtcgagggatccagggtcgatggcgtcgacagtcccggccggcccaacggcttcagctaacacggttgtgcagagtccttggccacagccgatttcaaggactcggccgcccttggggatcgcgccccatccattgaccacattaatgcgatgtgtggcttgcgtgaaatcggggttttctggcggattggcacggtctgtggggttgtaggtgtaggatgtgatgcgatatgccgctgaggctggaattgctactgcatcagacattgtaagagggttgtcggtcaacattttatcttgggattccctaatcttcatgtgtgatagaaggaagatcatacaaatcctaaactcaatctataatctaaggtagctttatttcataattgttcaaagacgaaggaatctttcgatctatgtgactctaccgttggatgagtcaccacgactcaccagttgcatgtaacgccaagcttactgctccttccattccggcaatggcggcatcttgatgaaaatcccaagctttgctctcgcgaaacaagccacagattcaacgagattatttcccagaggggtaggttccacgatctagtgagaaaggtacccgccaatatcatgtgttgccataccttgataatcgtctgccttctgcgcctaaaacaaacgccccgacgaacaactaggatcattccgatctgctggggcattttctttcatggcatgctgcactgtcgatggtttatgtcaaacggcctgtgggtgtttccaatggaacgcgtggggtagacgtagcgtgcacctccaagctggaatcacagcgattcacaattcattgagatgtctgtggcttaagtgattcgtaaacaatggactgtatttcaccgccctcatggttggcctcgtgtagtatcggtgtcgggccctggcagcattcattgctgttgaactttattctctttctcttccgtaacatcggtgtagttgctggtttgatgctacctatcctggggctaagatgagtatcgcagttcgtgaggccaatacatagctgagtcgtgttccgtatccgtcacttgccttgctgtacctgttgtttctagaggtagtaccttgccttgatccctggagaaattgtcgtggctattttcgacgagtagacgaatctaacttggaaatggtccaagggcggacaaggattgagcactttcattgtatgtaggaaatggcaaagctttacaatcatgacctggttttcaacgagtgtagatggattaaaaagagcgttggacgaagcacgaaaaatacctgcattgcttgatctctcaaaaagtatggaagacaataaaggccgtgctcttagcgaaaaggcaaacgtggaatctttaatgtgtctagtccccgtaagaccgcagtatccagatttgtcaataattatacatctatgctagcttccaacaaggagtgttagaaagcgcccattgcaaactcggtggtgttaatccatggtcgacccgtcgcgaaaggggatttctgattggtcccttgttatgattttggtgctactaactacggccgtttataactttaccattagtaagcggatatcgggtgtttgaacgcgaacgggcgggacttcggggtcagcaatatctcctacgctagcccaactgttgacttggaatgcgggacacggacggcttccaagcagacaccgcaccggatgctttcattgaatccggggaagacgcttcgggtcccgattgtcgcgttttcggctcgtcgatgcccccgattcggcttacttctcgataagctaggcttcttgtcgaagggatgacagcaaccggacaccccggccagccgggctgatgccgctacgtgtacgagtgacattcaacggagatgggatgtcgcagcttgaacataactgataggttcgggcgactcaactagccacgagtcctgggcttagacccgacgacggtaaaaggagcctccggaagagtcgcagcgcttcgtgctaggagatttaggtttgtgtatgttgtaaatgacgacgatctggctggtgatcactcgcgggctcatttgatttggcacctgtacttaaagctgccggtttcgtgatagagaaatcgacttgagagtgcattcttacttgcgttctctagccaaattaccagtttttttttccccgtcatcgagcacaattcttcacgcctatcattccaaagctaagccatgtctcttcctcgtgaacaggaaggggcggcgcccaccatgagcgaacatggattggacgccagctgccagcacccccccgagtcacaagaagctcatgacatgtcgtcttcaggagacggcagcgattctgccagcgccaacgaggcagattctactgatgacgagtctacatggcctcaactctcgcagagagtctctgggttcatttctcagtctgaccgacaagagttggaacgtatagcgactacattatccaggcgtaggagcgacgctcgcccacaagcaggtctaaatgcccatagcactgctgcttttcgcgacgatccgactttggaccctcacagcgagaagtttgatgtggcccgttggattagagttgctattcgacagatggaggctggaggctacaaatcacgacacactggtgttgttttcaaggacctaagtgtttacggttcgggcgaagctattcagctgcagcagacggtcggggacatgatgctggcaccgatgcgggcaacgcagctccttcatcgcaagaggggggcgcccaagaccatcctcaaccgattcaacggtttggtcaacagcggagagctgttggtcgtcttaggtaggccggggtcgggatgcagcactctgctgaagtcaatttgcggcgaactccacggtctgcaagtcgatgaggaatcatccatcacctatcgaggcgtctctcagaaggagatgcttcgcgagttcaaaggagagatactgtataaccaggaggtaaaatgaccttttctactacccctgcttggttttcaagtttctgacaagtttattacgatttcaataggttgataagcactttccacagctcactgtctcccagaccctagagtttgcggcggcatgccgtgaggcagacggcgcccacaagcttcatggcatgacacgcgaggaggtagcccaatatcgtgcccaagtcatcatggctgtttgtggtttaagccatacaaacaacaccaaagtcgggaatgatttcatccgaggagtggtgggttttcgccttttgttgtccagatattgcccaagttcacgtgagactgacctcgagcgtagtcaggaggagaaaggaaacgtgtcagtatagcagagatgttgattgctggcgcttcgctttgtgcgtgggataataggtaagcagtgaaccgccctagtcaggcgtctggtgatacccagaccgaatcttccgtaactaacagatcaaaatagcactcgaggccttgattctgccagtgccctgagatttgttcagacattgcgcctgagttcagacacggccaggatggcgagctgcgtggccatttaccagggcagtcaggctatctacgatctgttcgataaggctacagtactctatgaaggtcgacagatctactttgggcctgctgatgccgccaaggactttttcgaaagacaaggctgggtttgcccaccccggcaaacgacaggagatttcttgactgccgtgaccaacccattggagcgtcaagcccgcgacggcatggaggctcgcgtccctcgtacgccggacgagttcgagcggtattggcgcgaatctccggaatataccaagctgcagctggatatctcagcctatgagcagaaccattcaacgcaaccggagagccacggcatctctcagcttcgagagagcaaagctgccttccagggaaagcatacccgcccacaatcaccttttatgatttccgtcctgtctcagatcagacttactacgaagcgggcctaccagcgcatttggaacgacctctctggatccctctctcctcccatcgtgaacattgttattgcgctcatcattggctcaatctattacggcacgcctagcgatacatctggtcttacttccaagggcgctactctgttcatggctatcctacttaacgctcttagtgctgtttcggaaattggaacgttatactcgcaaagaccgatcatcgaaaaacatgcctcatacgcgtactatcatccggcaaccgaagcgatcgcaggggtcgtctcggacattcctatcaagttcgtcaccgcagtctgcttcaacgtgatcctgtactttttagctggactaaggcgtgacgctggaccgttcttcctcttcttcttggttactttcatcactacattcaccatgagtgccgtgtttcgcacaatgggggcaattaccaagacagtctcgcaggctatgacactagctggagtcttgatcttagctcttgttatatatacgggctatgttatttcggtaccagatatgcatccgtggttcggctggattcgttggataaaccccatattctacgcctttgagatcttggtcgccaacgaatttcatggtcgagattttccctgcgcggccggaagtgtcgtaccgccttacaacccgtctgtgggagactcctggatctgttcaacggtggggtctgtcgctggacaagcatacacgagtggcgatgcctacattgctgaaacatacgggtactattactctcatgtgtggcgcaactttggcatcctcgtggctttcacaattgcctttatggctgtctactttgtggcatccgagatcaactcatctactgcggccacttcggaatcccttgtgtttcgccgtggtcatgtcccagctcactttacggatgtagccgcccaggagcaatctactgaagacaactcaccttacgtcacttcgaagtctcatggtgatgaggaaccacaagtccatgatctcgagcctcagacagatatcttcacttggagagatctagtgtacgacattgagatcaagggtgagcctcgtaggttgctagatcacgtcgctggatgggtgaaacccggtaatcttacagccctgatgggtgtctctggtgccggcaagacgacccttctggacgtacttgcacaacgaactacagttggtatcgtcacgggggacatgttcgtgaatggccgaccactcgatgctggctttcagcgtaagactggttatgttcaacaacaaggtaagttccattagaaatcatgcccacgttggaatactgctgaccccgcgcagacttgcatctcagcactgccaccgtccgcgagagtcttcaattcagcgcccttctccgtcaacacaagtctatcagcaaggaagagaagttcaagttcgtcgaaaatgttatcgatatgctaaatatgcgagatttcgcgaatgcagttgtcggagttccgggagagggcctcaatgtcgagcagcggaaactgttgacaattggtgtcgagctggctgcaagaccgaaactattgctctttcttgacgagccaactagcggtttagactctcaaagttctcgggctatctgcgctttcctacggaaactggcggatatgggtcaagctgttctctgcacaatccatcaaccgagcgccctcctatttcaagagtttgatcggcttctcttccttgcaaaaggtggcaagacggtctacttcggagatattggtgagaattcacgtattcttctagattatttcgagtccaacggagcacgtcagtgcggtagcgaagaaaatcccgctgagtagtaagtttaaaatttcccagcgtggcggcaggatcagacacgatactaattgaatgtcagtatgcttgacattgtgaacaatcatactagcggcactggaaaagactggcattcatgttggaacgcgagtccacagcgtcaagccgtcgacgaacacatcaaccatctgaatacagttaatgtcaacgcatcctccaccgagcacaaggaccaagatggttcttcagaattcgcagcgccactcatccaacaacttcagcatgtcaccgtgaggatattccagcagtattggaggatgccgtcatacattgctgccaagtgggttcttgcaattgcctctgggctgtttattgggttttcattctataatcccgatcaggacctggctggcatgtcaattgtcctcttcggagtgtttatgatttccaccatcttcactactttggtgaaccaggtcagtcaagaaccaacgccgcccgattcgaaaatcccatcttccctcctctaacaagattggacaggtacaacccctgtttgtcacccagcgtgacctctacgaggtccgcgagcggcctagcaaggcatattcctggaaagccttcatcattgccaatattgtcgttgaaattccctaccagattgttgccggaactcttctttttgcctgtgtttactatcccgtggctggaatccagacatccgatcgtcaatgtttggtcttgctcttcttggttcaatttcttctttatgctagcacagtcgcgcacatgacgatagccgccctacccaacactcagtcggccagcgccatcgtaaccctacttttcatgatgtcgctcacattttgtggtgtgatgcaagctccggacctgctaccacgcttctggattttcatgtatcgggtatcacctattacatactggattgctggaatcgtggctactcagcttcacgaccgagcgataacctgctccgccacggaaacttctgtgtttgacccaccgcaaggccagacatgtggtgaatacctgtcagactttctacaagcagcacccgggcagctcatgaaccccggtgacagctctcaatgtcagtattgcagtctctctgttgcagatcaattcttggcttcggtcgggatttcctggtccgagcgttggcgtaattttggcattatgtgggcatatattgggtttaacatctttgctacggtcgttctttattacctcttccgggtcaagaaatggagcagtcctaagacgaagaagagggagtgatcttggaggtaatggctcttgaagggagcatggttggttactggggccctactactaaatataaaatttgtcgtaattagttaggattaataaggtgatttgaagttttagaatagtttattagttagtctttaggttagaataataggtaataaatttactgagtatttatcatacttttttgaagcattttcttttaaataaggcattatcttccctctatacaccctaccagtaggattggctgccatcggaagccaggaggagtatgtcccgggcccggagctgcttccacccgcacgcgttacaaaacctctactaaatcttcgtttggctgttagaaacatgggaacagttgaaagccataaaaaattaccagatgggctacagcatagatactgccacgtggcctgaggggttgaacatccccgtggaagtgaaaagccttattgaacgctttttcgagactgttgacaccaaccgtgatgatgctggtgatattttggcagatgaactattcgctgaagatggcgtggcttactttggtgcccatccctttcgagggatagaaggtacggtatggtcagaaagcattatcaagaaaatcatctaactcagtcggagcagaaattcgaaagtctcgaatccatgcatgggatacgatagaaacgcggcagcacaagatcctgagagtgtatactcgggcgcccgattgtaacgacctcctgtttgttgcacatgtggctatgggtctcaagaacggtaagaatgtcgatggagagttcgttgggcgttttaccatctccaatcgtgagcctaagggtccgaagctttcactatatcaagtttggggcgtatgctatcatcctactttcccctcaccttctttagctaaagcagcaaggctaatgagacccaggatacatccgcgctccggacggctctccaggaaaagtaggacttgagatctaaaaaagcctcctgaatatattcctttcgcttcctagttgctttgtgctctgcaaataaggtacaccacgaagggtgatgagagaatcgacatgatcaagtaagatatagggaaactcaaccatctatttgtattgaatgagcgtaatcttcgtgatatttggctctcgacgaaaatgccgtatgcatattcagagcttcgtgtgcctttgccctcgtcccggtcgggacccggaagacggaggttactttccgctgatccaaatctgggcccattcggtttcttcccgtgaggagatgtcacacataatgacgccgagctcattctcaatgaattttcttttctacggcttacatcacgttagagttaaaatcgcggcattggaaatcactgcgttctctcgacttatcgatctcgctaaggataaacatgccgaaccaaagtcagcaggacagcaaagtgctctcgccgagagctttagcgcatgtcgttcttcgaacttcaaatttcaagcccatggtagcattctacaagacttttcttggtgcacatgcgacatttgagaatgaatttctctcatttctgacttacgatgaagagcaccatcggatcgcaattgggaacgtcccgggaacgtcggagaaggtcccaacttccgcagggctcgaacatcttgcgttttcctttaacaacctgcaagatcttctttccgcatatacacagcggaaagctcgagggatactccccatatggtctgtaaatcacggaccgacaaccagcatctactatcaggatcccgacggcaatcaaatcgagacgcaggtagacaacttcgacacggttgaagaagcgaatcagtttatggcatcctcagaatatgcagagaaccctattggggtagattttgatccggaaaatctcattgagcagctgagggctggagatgagaagctcctgaagaagagagcaaacattggccctcggggtttggacactattcccaaacctccccccagagatgttagagagtcttatgacctcatataatgccttggcttctaaatcgcttagccttcgggtggagaatggtgtatgagtgtcgctgtttttccaacatttgatttttgtcaaagaggctcaaaataagggtattcgtctcctgagccctaattattctttggctagattgtctttgcttaatcgatagtgatcacactgggtcttggttttgtgaagtaattcctacgtgattcttcggtcttcctatattacgtgatttcataatatctcatggtgacctagcataaactgtgataatttccatcggatctccgcgggccgtgagtgaagcgttagaccgggcatcctaaagccgggtccaggatctcatagcatccacagctaattatagtatagatacgaccatacttgcacccgctacgacagcatagggaggatatatgcgacttggacatcataaacccagaattacacaatggcaaactggaagaaagaggtgagctgcaaagcccatatgttaaatgagtaccctcactgaaagagttatagacagatttcactaccgtggatgctctccacaacgatctgagtaatcctccgagcaaagtgagtagtcttcgcccgggtgttttcttacttacttggctaaacgagaaaagtatcatgacccggaactggccgctaccgaggaagaaatcctggagttttacaagcgatttggcaactttctcaatcatgtcagccatacagatgtgccagcaggcaaaaaattctttgaattgaaggactactccattttcgacctgatgggtactgtatctcggccaaacctcgaacctcactatgatcatattacgccataccttggaaagaccaaccagcaatttcgtgaagtcgagattgtggcagttacaaaggactttggctatatcacagctgtgcagcgagtagatggaaaagctgctgatggcgaaccctatgatttctcattccgttctacgtcacttttacgaaaggtcgatggaggcgaatggagatatgtccatgagcactactcctttccagttgacatggcgacgaagatagcggacttcactgggaagcaagaggctactgaatctgttgaattcaaaaagaaagaagggaaataggaagaacttgatgggagagacgagcaagagttcttgttatggtctaaatctactctaagttctatagcacccgagtatagtcacgcttgtcatgcattggatttcatttcacacataagacgacccacgaaatggctcaatggccttgattcaacgagtatgacttgtaagtttgaattggcctgatcattccgctagatgggggaatggttttgactgcttatggaagatgctgtatctacgatccgagtatgagccaggtttattgcctatactcaaagaggaaagtgatacatgccaatcaacgactgtctctgcaaatagaatctactcaatgcccagttgcggaagacaggtgcgggccattgcaagcaggtgctcattcccggtttccggcttgtttctgtcccgcggaggtaacggtgcgattgtgccgcggacgtccaatatcaacaatccctagcgaaaaataacaggccacggggaaaacgaatacactcgaactgcggtaaggtctatctggaatttccgggcaacttctagaataaccaagggggaaaagtgcacccgcgtcgggagtgctaacggtggagactcgcaatcgcgtcatggatggatagagtagcgaaccggaatgaaagtaacaaagaccttccgtaaattctgaattggagattatcacttgtgtgttattttcgtcagtctctcttgaatttgaaagcggatggtataatcttcgttctgactgagattcgtcagaaacatccacgaggcgggaaacttcaataagccagcttaaaattgtagaagacaaatgagtaacgatgatacaacagcagatcatggattatctttcacagttgaatgtatcctggatgttgaagaaatccttgtctctgatcttcatctcggtcgtaagttcgcttaacttggctttagaaagatcttactgactgcgataggctattttgggcatttcctttattgttacatatgacaagcgacgaaagcacctgcctccaggacctaaaggtctgccattcattgggaaccttaaatcgctgtcaaatccagatgaaatcccgaatataacaagaggctgggctcgagagtatggccctatagtgtacacgaagatgggtggcggcgattggatctgggtcaactcagcatcagtggccaaggagctgtttgacaggcgaggttcaaagtactcgtcccgtcaacgaatgcccatggcatttgaggccacgtcgaatcaaaaccgcgaaatatttatgccatacggagagcgatggagaaaactgaggaaactcagccacgcagcccttaaccttaacacctctgcgacatataagccaattcaagattttgagtccaaacaagtcatgtacgagttcctgcatgccaaagatgacatggcattctacgacatcaatcgacgatattcagctagtgtgatcatgacagtcacttatggacaccgagttgcggactggaatgaccgctatatcaagaagatctacgaagttcttgagcattttactttaatgtctgagcctggagcttggttagttgatgccttgccatcgcttgcaagtctgccctcgtggatggtccagaattggtggaagattggacgcgagtggttcgagtacgaccgccaagtgtacctcggattttacttggatttggtgaagcagattcaaaatggaacggcacccgactgtgttattcaagatttctatgaaagtggactagagaaaaagggtatcaatgatgagcaggccgcgtatgccgcggggggcttggtggaagcgggcagcgagtcgacctcaactgtcatcaatgcttggatattagcttgccaaatatatcctcacatcatcgaatccgcccaagaagaactagaccgcgtcgttggtaatgataggatgcccggatttgaagacgaggacaacctgccctatatccgagcgatggtgaaggaaacacttcggttctggcccattacaaagcccgggatgaatcatgcgacaacagaagatgattggtataatggctattttatcccgaagcgaagtgttgtaatgctcaattggtggtatgctgcgcatcttttttctcaagccgcggaccatattaacattctggatagggctattcactatgacgagaaacgttgggacaacccagatgaatttgacccaacccgataccttgatgataagtatacgactgccgaatccgtaaatttggctgatggaaacgcgcgggaccattttgcatatggcgccggtcgtcgtatctgcagcgggatgcatctcgctcaaaactcgctctatatcaatatggcgcgtactctttggggattcaacatcaaatgcggaaaagatgagaatggggtgcccattaagcctgcattaaagacagaacctgggttcttgatggttcctgctcggtttcacgcggtactggaaccaagaagccagaagcatgctgatattattgaaaaagcatggcaggaagcagagcctatgggtgttttaattcaacgaaagaaagcacactagtctgttaattagtttatgccatttggatcatcataaacgtgaactatcgcgaaattacacctctactttctgacagtttttaacaatacgaaataccacaacagccccgatagcttctctattcactaaacgaagacaactccgtcatttatttctcattaagatgcggctaaaaatgtaaagacttcgattggattgtcggaataccccgtgagacgtacaaagaaaaagccaaaggaacttcatttattctcaacaatgatagccaagaacagcttccaaaatgccactcgcctgggataaagtatctacacgatatcccctccaagcaacatgtccatcaggcctcaccagtactagaggtcgctcccaaatcttcgcagctacagcttcttctcgcagttgtgtaagcttaaggggtgtgttgagtgcatttgccgcaatgatgaaccatctgcttctgctgtgttcagcttccttgtcttgaaactccaccagtgtaaagaatggtccaaggtggtcgaatatggatgatttgttacttaaaatgacatggggcgcacgactgcctggccaagtagttggtaaataccttttgggttcccactctggttttgttcctgtcgaatcaggaagacaaactggagattcgtaaaggtagcccatttcaatacccatgtccttattctctccatcgttctcttcgtaatgcttcaaaagagtctttcggaggctgataccctctggagacgagctttcgatcaccttgggtctgtcacccagaagctgcacagctttcaagtgtacacccatgtgtacgcctgatcgttgtacattctggtacgcaatcggtttgcgctctgtttcgtaggtcctcaacaagccattccgagcatgtccgttgattactgcggcaagtttccaactgatgtcaaaagcatcacccaaaccagtattcatgccatagccaccggtcggaatattttggtgcgctgcgtctccagcgaggaaaacacggaactctggactggcgaaagagttggctacagcaatactaggccgaaaagtcgacctcactaatacttcatcaatcttgattttgtacggctcgtgtaacccaccaagcactgtatatatagcgtcctcggaggaaatggaagactcatccacgccactcaagaggggataatggatagtgaagatgtcctacatagacttgttttagtgaaactggacgtgattgctggatattgttgcataccctctcatcctgtgatatcacggcaccgccaaaagagccattagcaaacgtgaataaatgccaaaatcttccttgtttatgaagatgttctagatcgcgcgacttaaagtgaacgagtaagaatgaggcttcgctatattccccgttggttagtacgaatctcatcacagtctttcattcaatgaaactcacgttggaccgccatccaggtctatgctgagggactttctacaccggcttgaagcaccatcacaggctatgacataactggaaatgtaatcacgttccccttggcctacttccgcaactgtgcagcgagcttcttgttcaatctcttgaatggattccagcttggagccatacttgaggtcaataagcggattttcctgacacaagtctctcatccatgtctcaaatatgctttgagatactctcaagtatggctcagctggttgactgccgtcgttggtagattcaatgttctctctgtactgatcgacggatacatgatcccagcttgcgaaagcagaatcttggcttaagccagtcgacatcagcacagtatacgggatatcacttggaactccttcatttaagtttagccaatacaagcgcacaggcatttgacctagtaatgagcaacgtacccagcttacgtagctgatctgccagcccaatttttctcaacagctccatggatctcgcgtttgtcaagtccattttgggccatcttcaacatccaatctaagttatttgttttgaaatgtggagtgagggcatctcaccttgttggctcagcattgcgctccaaaacaatgcttcgtacaccaaaatatgcaagcaccgaggccaccattaacccgactggcccaccaccaataacgaggacagtatcatctgggactttatgcggctcggatgtaggccgggattcagtggtaggggcatctgctttcatggttaaggctgtgataagtgcgttcgcgttgtgatgcgccaaacagacttactaggagcatagctacttgcaattaagcaccaaattatccaaaaatctaaggatacctcggaatggggtgtaatccaggccaaaaataatgaggggttacggatcccgaaggcccggtgcgtaagggtgactgtccgggccggaacggattgttttaccggcagcttagcggaaagtagtagaggtaaacaagaaacagtaggagacagactactggagtaaggtaatgaaatttcaatccggcgacttttggcataaataatctgtttgtactggactaataaccaaactagtcattcgtagcgatacatgttattaagccatcttgcccctctccctctctgtgacgctcataataggctctagagatttgacaatcatatgctctgggacatcggttccttctggcattttaccatcaaccatacccggtggctggatgaaccattccggcacgactctggtccctaatttagaaacctcgaggattgttccgccgggatactcaggagactcgatcccctcccttattgtctttgcaaccacttccggcgtgatcgaaatatcttcgataataccaaatctttccccagagcctggtgtgcctgttgtccaaatgggagtactcacaattctacccaatgataagacgttagagcccgctgcaagatgcgcggctatgctttgacttaccctggacagatactaatgaccttgacgccttggagcctctgtgaatcgcccagactcctcgtaaacccaaccacggcatgtttagttgcgctatagatgggagctggatactgcttgctgtatccagcaatggaggagacaagggccacgacaccttgtttttgtttaccaagaagcgctctcattgcgagtcttgtaaactttatctttgaaagaaagtcaacacatgtcatttagtctcctcacttcctcttactcatgaactcactgtgtggttgacattgatgtcgacatgcttgtaaccattgctctcaagtggctcaggatcttcccagaagttggaatacggctgtagaattacggtggaggcttagcagatgtatcttctcagagaatactgagagattggttatctcactggctcgaaaacgcccgcagatgcgacataaatatctggaacgtcaccaaatttggttatgcaaacatcaatcaaacgctgcaagtcggcccattgagtgacatcacagtgctgaaatgttaggtttgttgttttggccacaaccttctgggcttcatctgtcagttctatgtctccaataatgactgatttagctccgtttgccgcagcgaggacagcataagaaagtccaatccctggagtttttgacatcagcgatgcccgacttagtagatgtatgaagcctcacctgatcctcctcctgtcactaccacgattttgtccaaagtcgaaaacggccaagacattttgatgcggctgatgagttgagttggtagagactctctgtttccgtttgcatcctagggtgggacattaggacttgagggttgttcagttttctctagtataatgggatcgatgtcccgctacgggcctagctacatgactcccgggaccgcggcatcttattaaatacatcccgacgtctggaaacacttgtggcacatgatgaaataacatccggacccggaagcaatggtccgctcctagatcacatgtagttaccaagagatttccttacatcaaaggcgcctctctgagcagaagctctggtatgggaatagagtgccacgattggttttgtatacgtactattgcaataaatcatggcaattatttccatcgcccaagagcatgctactttaatatgctgtactatagcattgctaggcagcctttatgctctgccaagggttttgagatataggagtcgtacaaaggacttcccacctggtatgcatggagttgacaaattcgaggattattataaagatgagtaactgggctgaccgattatccgagggcctccgacgttacctattgtcggcaacttgcatcagatgccaaccaaggacttccatcttgaatttcaaaagttggcccatcaatgaatgtaccccctgtgtgcttagccatagaaagtcctttgctaaccaagctttagatggacctataactacgatgaagctgggaaacctgaacatgttcctcctcaatgatcctgctgtaattcgtgatctgctggagaaaagaagcaataattattcgtgtcgcccagacctatatgctcgacagtttggagacaatctcaatatcgcactgcgagagtatgccatcgaatatgaatggtttatagagaagtactgataaagtgccagtaatgacgagatatggcgtcgccagagaaagatgtatcacgtccgcttaaacgtaaagtccgccgatagataccttccttatcaggtgagttctgtttcagctatcgatttgactgagatgagcaactgacatccttttgaacagcactgcgatagtctgcagcttctggatgatattgttgaccgcccggatgcttggcttgaacatatccaaagatacactgccagtatctccaccactttgctgtacgggtggagaacacctcacaccaacacgggatacgtcaaagaccttcttgaagtatgcatgatatctaagtttgatctttttctatcgttaatcatatagaagactaatgcagtcattgatagtggatggaggtcacctccgatgctctgaacttccagcttgttgacttttacccttctctgcgcattctctataaagtccttcctggttgggtgcttccaagtaaaagaaagctccagaaccttcagaaactagaaaaccgagtattttacgatctacttggaaaagcaaaggagaggttggaagctggagaggctcatcccagtttgtaccatactgacattgttaattgtcgccttctaacctcaacgcaggttttatccgcgatatgttaatggaccaagaccacgatcggctagatgaccgccaaattgcgaacaacgcagcacatggtttcggggctgcaatgtgagattaaagcttggatatattatctttcccacgctaacaacccgaagggacacttcagccaatacccttgtggggtttgtcaaggttagaaagacaacccggttttgggattaattcatcacataatctgaccctagaacaggccatggtcatgtttcctgatgtccaagcgaaagggcaagaagaaatcgacgccgtgatcggaggtgatcgattaccacaatgggacgatcgcgaccgcctcccctatattcgtggcatagtggaagagacatttagatgtgagtagtatcattcaagtcttcctcaggtagtgtcagtgtactgaatacatcaggggcaccgagtcctattagtgcggcggttccacacgctgctaaagaagaggacgtttacaatgggatggttatcccgaagggatcaatgatgatgataaatgtaagatctgcttcactttaattcattccaagcttgacaagcgctagtgaggagcgtcagtgaggctgaatgtgttgatgtataggtttggaccctgaatcatgatcgtttccccaatgctcgcgatttcgacccgacgcggtatgcacctgaaacaactctggtagaaaataactccatcagccaggattctcctcgccgaatgcatttcacgtttggggctggacggcgagtttgcccaggattccatgtagccgaaaggaatatatttatcgcagtgtctcgcttgctctggggctttaatttccatcgagcccgggacgtaagtggcaaaatcattcccattaatcgagatgcggtaactcccggactcattgtacgaccggaggattttgagtaagtttgaaacacgaactttgtccatgtgaaatcttctaaccatcttcagatgtacgatcaaggttcgcagcaagagccgtgaagagtttattcgaaagagttggagtgacgcccaagagaaccttgacagcgaaggaaacttcacccctgagtttatcaaagcctctttcaaataaatgacctaagtagttacatcatagcccagaatatcaaatgcgttacttcaataaaacaaatggtgttcaatgatgttacaaggctatattaaactactgaaatttgagccgctgtggaaatttgccgactataagtgggccattactagacccttaatgacacacataacggcatatcccatgagttatattgaagttacaagtttaatatcgacatcatgtatatttatgaatgtcagaaggtgagccgaatgttcttgatcatgctagtgagagcattctgcgcgtcgtggtagaaagagaagaacattgacgtgcattcgatacaactccctactctctggttttgtaaaagtcctcatccactttcttgccttcgtgagatagcatcatttcaatattccaatcttcgtgaatgtgtccgggtggcacgtttttcgactgaaatggcgccccatccagcaagtgagatttcacggcttcgatgttctcctcggcgtaatcaactgcatccacaccaagcagccaggctggctgaggcagcttgagaaattcagggtttgaggcaacggcattccagtcagtctggtgccagacgtgtcgagtctcccatcccatccgctgggtgagactcgtccgctcgtaacttcatatgaattagtgaaaagtacctaggaggaaaacttgtttcgcttaccgtaatttttcatagcatttgagagcaattgggatgttctgtttcccaagcttctcaagaacgactgcgatcgtagccgcatcctcaattgcctgcgcggctccagtgccagaagtggcgaggtgaggatgtgccgcatcacccagtagacaaacacggccgccgttcgatacccacttcgggacaggatctctccaaaggagtttgtagtcaataaggcattcagggggaatgctctggataatgtgtctaagcaccggatcccactcttctacacaagccaacatatcctggacatctccagggagattccagtcttctacaacatctgagtgatcctgttaggtgaaaaattagcaatcaaccaagcttagaatggaagacatttattttcctactttgtgagtgacgaagcatgtggcagtttgaagggcgcgatttgtcgttagaatcgcatgcgtgttttctgctatccagattaggaatatgtctttcttggactcgtagattgatctcgtaacagggtcgttcttcaactgggagaggggaaaccaagatcgatatacagcgaagccactcttctttggccgttctgctgcgccagtgacatagcctctggtccggctatgaactccgtcagatgcaagcacaacgtcggcggtatacttaatcccaccaacaatgacaccagcggaatctccctcttcaaaaacctcggtcacggctgctccaaagctgactcggaccctgtgcttgacggcctcgtcgaacattctcttttggattcttcctctatgactgtaaatgttggggaagccaccaaactcagtatggagttgttgatcgaggaggagttttccgtccttgttctggattgcaagaactgttggtagtgctgactccttcacagtctcactcaacacatcaccccacctgctcataagccgagttgcgtttgccggtacttggatcacgtcccctactacgggtcaacatctttattttttttatgatactccctgactcataccttgtttagtcatgtcgggataagattcaaagacttgaacatcagcacccttcagggctagctcaatacttgcggagagtccgccataacctgcgccaataatgattgcggttatgccacttagggatgtcttctgggccatgttatcgtttgcctattgtgtggtgttgatagtctgaaactggacgtatggcaatttcattcaaatcgtctgaaaagagaaaaaggtgataatataatggaattcgaatcattcaagagtttctagaatatgccggtctcttattatcatccatcgacagttcgcgcggcacattactactcccggctatacgatttggcacataggacttttagcaaagctcatctcggcttgatttacatggaccactcccggctttttgtcgcggattagacgtttatcatcatatagcaccttttcatgcgagtccaaatcattcccgtggttattcctcaattcttggactcagtttcatcggactgttgctgtttgccggaggccggaactctttggacccgaacacccggaccaataacgaacccagtcccgctggccaaggtaaggcatttgattgtatgggtgaagtgtcacactaatagacccatatctagctgtgaatatggcctgactggccgtgggaccctgcttccctgttttgggttacattttccccgctctgaagaagtaggtaggcatgcttccccagatcctcaactcccaagcttagtgctctcggccttttcttcaagtacagatacacattactctaggtttgattgtggtattgacacttgagccactaatgagtactatctcgcctccacaatgggatgcaagttaggagctcacttttggaaccacaagtccgtcctgcatggacaagctggtttaccaaccgtgatggggcatcagtgctgtgtatgcgtcaatgctatgtatctatggcacagcaccaaacgcacggtgacatgtcaatgtaatgtcttccccgcattaaatggtggtgtgtaggatgagcagtagtacctctctcgtagacctacaaccctcggtaatccgacttgcatcgccaccccgagcccgtgatcaccaacctagtccaatacacggcgaggcagagaaacaggagcgaataatcaaacagttgtcggcgccttcgtcggaaggccaggacctcgaccttctctgccaggggaaatcagtcttgaggcgaccgtgaaaatggcccctcagcgcgaatccaccaaatgtccgctcgcatgcgaatactgtagggtcaaaaaagcaaaatgtaagtcaccaacatgatagtctacatgtactcctgctgacgggtcatctcaccataggtagtggaatattcccctgtggtaattgtacagtcagttatactcatcaggggtaagggatctccatatgttaacacatctcaggatcataatgaagcatgtgtctttccagagaagcgaaaaaggactagaaaacgcaaggagcgcgagatagagatggaagataggttggcgcgaatggaagaattactccgtgcgtcggctgctcacaactctgtcggcgagagtcagccaagttgcaggatcaactccccggatctgtcacaggaatcatggatgagaagcaccgagcagagtgcccaaaacaactgcgatggtgaaacctccgaacagacgcctccgcaattgacaccatcggcgcaggaagcctccagcgcgactatcgtggcctcaccatatcctgccatgtctctcaatttcccagatcaaatagattacagccagccgttagatcaggataccatcacgattgatccaagctgttctcagataccgactgttcaaaccgccaataccataagcgcgacatccaactttcgtgtgccagtctcgccaccaagcacaactgcagcagaacacactgcgtcaatcgaggctgaagtaacatacgcttctctttttagcccttcaaggatcacgcacagctaacattctttgctaggatcaggatgaaaatcaaggtaagaagtggtgaattcaaatataataagaaaagaactggaattaacctaaagttggcttcatttcagagtgtgcctcctacctctcgatatgcacattcccggcgatcaagtgggtatctagccaggcaggaatgtctgatttcctccttagtgctcgacggttatcaaagacagtcatgcagggagagaggcttggccaagtaactggctcaacgagaacgctagaacccagttacgaggtggctatggagtggtcgaagggtatgtatggaagctcggtacctaagagagactttcaaattgctgatcagcgtgactagcatactttgacagctgccttgactcaatcttcggtatcattcacagagatgattttgaaaaacgccttcaagatcattttcagacaaatccaaattcatgctcagatgcttcatggtacgcattgagaaacacgatatatgcttcaggctgtcgggtttctctttgtgcggactcaggcccagagtctttttccaggtcgagagcacaatcttggaagtattttgaaaatgcactctctgtccatacagagttgctatatgtcagcacggacataacgtcaatccaagccttgattttgatggtaagttagaattcgttggatgcagaatcttgagctgaataagagactcattttatatcgcaaaggcattccatgctgaggcactaggaacacctgcgcttgagttcatgttggtatcgagcgcgactaggttagcacaagcaaaaggactacacatgcgaggttctcgatctagcaaaggcgatcacatggatactctctcaaaacagtgcctttggtggattatctacgcgtacgaaaaacatctcgcgtaccgatcagggataccttcggtaagtccaccttagcgaaaagatatggcgggtttctaaaaacaaattgcaggccatcgatgatgactcgatgacgtgcttagttcctacagagctgaggcgcggatccggtacgactatggagttcgtcaagcagactatcgctctcgcacggctatcatcctctatcaccaagagactaagtgctgtcaaagccatgagagatcccccagatgtggtactgacgatagttcacgatcttgatcataaacttcagatgtggcgagaggggctggatccaacattccagaagcagcccccttttcgagcccattgtctgcctcagagtacgcaggtagcgcatatgctctatctccactacacttatcatgctttgttgatagcagtgcatggagtattttgttatccatggaacaggcctgatcttcaaagcaacgaaaagcccgagataaaggcccaagtgcagagaagcactgaaatagtagaagagtcttcacgacagatcataattgccgtgcaacacgttgagatcactgcagccttgcctgtttggtaatctactcaattccactgttcagatgattttgacttatatactgaacatatttttaaggctcaccttctattttcctcttgtggggttgatcaacatgttcgtttgcgtgctcaaaaacccactcagcccttctacgacgtcgaacctcgctttaatggatatcgtggtcggtcactttggatatgttgagttcttgtcctcatcgaagctcgatctttcatttccaagagaggttgcgtcgtatgcaagaaacctcgtaaagaaggtgaaggaggaaaatgactataccacctccaccagtcagccgttgaatgtgcagtcatcactttctgcgcaagatccaatcgcaacagcagatgttcgtatcttcctcccaagctataaagtcccaagctcacataaattcatttcccagatgtcagcattcgaccctgtgcttggactagaagattggtgcacattcctgccttcgattccaccactcgatatatttgaacagccctttcccggagagcaaggccaatctttgggcagcgccttatagcttgtccatggctccgtgagcgcatataatcatctgaaactttgataagcgatggcgaaaacattggggggctgcttaccggataacctaactgtgtacgaaattatgaaaaaggcttgccacatgggaaggaattaatttaatcaaacatgctaccatatctcatgcgaagcgtaaaaccattaggattatatatcccactatacggattgactttataagaatctaaaatgcgttaaaagaatatgtccgaggaaagtgccggcacaccggaacatagggctaatgtggtctacattccggctggatatatcccatgatccactatggctcggaaggtcagcccccatgtccggccgaaaccgaatagctcggtataacctggatccgaaacgttacttcttgatgcaaaatttcgataggaagcctctttgtaattgtaatcattgagccattgaaattcaacacttcattcatgatgcccaacttcaaccgtctcgttcgtttcaaagatacggatgcaaatattagatatggtgaggccccttcttcagggtccttgatcggatctgaggtagacgtctacagtggaattgaaccgtggaatttgagtctgacaaaggagagagccgtgatttccgaggtatgctcttcatatgttgttccagtgcatatacgccttgagctcacgtcagacgaattttcaggttcttgctccgttgaattacactccaatcatctatggaatcggtttaaattataagacgcacatagctgaggcagggtggccgacgcctccgtatcccaccgttttcacgaagccatctggagctctcaatggaccattctcgatagtttccattaatccacagtgcactttgatggactatgaaggagagttagctgttgttattggaaaagattgcaaggacgtcactaaccctacagacgctctggagttcgtattggggtacaccgcggcaaatgatgtgagcagccgatactggcaggcaccagatatcagcggccagcagcatggatatgcgaagagctttgatgggtttgctcctattggacctgtgctcgtttctaagacagccgttgggcctgtgggtgacatggtcctcgtgacacgggttactgatcaggaacggcaacgagccaaactggatgatcttctgtttggcgttggtgatttgattgtacacttgagccgtggcacaactttgaaggcaggtactattatattaactgggacaccgggcggagttgcggcctttatgaagccgcctgcctggctcaagacaggtgatacagtggaggtggagatatcgggcatcggaagcattttgaacgagtacgtatatgaatgaatgaagtggctgtcctagttatagtatcaatttaaacgagttttcacaatgtcctattttcttccataccacgcttcgggttgccgtgaccccttagctgccgttcccttgctctcaatcatttccgagaagatcttcgtctcactgaacaatatttcgtgctactctactggacccggcttcatgtagcttggcatatcagcgtgacaatctccaattacgccaagccagttgagtggcagatggtagaacatgaccactgcaccagcagagaatccgatgacagcaaatgtcctcaccgcattttgtaaccgcggatgccagtgctcatagcctgcttcgactggggaacgtccattttcgaaagctttgagcctcatggcagtaaatacacaaccaagacttgcgacaaagatggactcgtagattgggaactggtagaccttttccgggaaaagggtcagggcccggtatgttttagcaaacccatatccatgagtgatgcggatagccaagttctcaataataaaatccaatacaaactcgatgcaccagacaatcgtgagaacaccggcattgctcaattgtgggaatcgagctctgagcggcattgccattttggaacccacgattccaaagccagcacaaaagtacacgtacatgggaggtccccaaagaaggctctcggcatatctgctagatgatgcatggttgtgaaagggcaaaaacttggcccagaccccgatgttaatgctgtgggaattccacatgaagatgtactgatagcagttcaagaatccgtcggcgcagagagctaccaagccgccaataacgtgccggccgtcgagtgtaaattctggccctttatctgttctcttgaattgcttcaagtacggaaaagccggcacaaggatgcagaaccagatatgaacaagaaggacaccgacgctgagcgcctcgaagattctcaagcatataaggcgccatgtttcaatttcatccggttccaagacgggagctggtcggaactcggttggagaagagatccaacgtatgagagcttgtatccacatgatagtgaaagcaagaccaaaggtggccatcgctgaagctgttccatcgcgtggcgtttccgtcgtttttcccctatcaccattgttgatcaacggactactctcgtccaccccatcgtcgtcatatctagatccattgcgatggtgaggaagaatagtgctcataatgtcagggcaagcgcgttcgttcaatggtttggatgattgttattgtaatgagctacaaagccacgctcataggtctattattgatatattcgctttcattttaaggaaaaggactcattatacactttaagggcagatttccattcaatcaatgcaattccacggaaccggtagagtgtctcccgccagttccggccaccgagataattcagcctggatgcgccaaaaatcagtcttggcagaaagttgccaatcatgtgagttcagttctacaaattattgaccagacggcgacctgatcatcatggactatagagatcattcccacattcagcgtcctccatgttggtataggtacatcacccttgcgctacttcgtatcccaattcagcaggtcggctccgagatttgtgaggggttgtcgagggcaatcccgccttcatttcccaaattccggccagtttttaccctggaatgtggaggtaatactaccctttgacccgactgaccttggtttcaattgagaagactccgtcctcgatgacaaatctagcactgcccacaaacagactcgttcccagctccttcagggactctgatccggtttcaaaagtaacgtgggacagtgccttgccaaaggatgtggatttggcttttggatctccggccagaatagcgaccagtgcctcgtccacctcaaccagtcccgtatacttgtagctcagcaggtcaccgtcattatttctgccgagcaaacagattaatgacacgaagcggtcataaaaggtttccattgatacttacctcaaaatcgcattcacatctatgtgagtgtgagtttgtgttggcgcggtacgtgccatatccgaccccatgactacctcagcatcaagcgggatttcgaatccgggctcgctagtaactttaccagatgtaactggctttaatcgaaggaacaagtttagctaaattgtcaagaatcttcattcattcgggagcttacaaaagcgctaagcatttcaccgctgaggatgcctcctggtccattggttagaagggtgcttataaaagcaacagataagatgtctaatcacctatgttataatctttcccagggtatagacgcactgtgaatgccggctcgagagatgggaactgatcagtagacatgataataatggcagaatgtaatctgcaaacgagcttattcaatagcaaaagcaatctactttactgtccgtacaaaccacagtacatcgcggaaatgtgcaagtattcaattcacgggctactgactttgagcttgagagggaagcaatcaagcaagcgtcaaatctaacttggggtccatcctccggcccgaaattgtgacaccgggaagccagtttctactttcgctccggggcatccggcggaggatagatacctcgccacctagaatactgttgggctatgagagcggacaagagagatatcggtttttatataatcatccatttatagtttctttctattcctaaagccgggagatgttccatttctgctgctgttgagcatccgcttgctcgatctggacgaactgcttgtaaaatctcaaacattccgggttggcaaccgtagagcttacttgaggatcctggccactaatgatcttcttgacaaggatttctattttcttcccattgattgtatgaggtatgtccggaacttcaaagatgtagcgtggcatgtgtcttgcgctgagcttggatcgcacagcctcacgaagcctgtttaccacagaactggtgaacttgtatgcaggatacatttgcacgaagaggatgacagtctcatcactatcatgctggcgtctttgccccacacagaggctatccaaaatttctttgtcgccgtcgataacgttgtatatttccgcagatccgaaacgaacacctgctggattcaacacgccatccgaccttccatgagttaagtagccacctgtagatgggtttctggatacaaaatcgccctgcgcccatatctgctcaccaaatctagaaaagtaagaatttttgtatttctcccccgtattgtctccccaaaaggaaacaggctggctggggaagggtcgggtacaaacaagctctcccggggtgtctgacattctaatcgagactcccgcatcactgtcgacatcaaatatatctacagccatgccaagagctgctgcttgaatctctcccgcatggagcggctgtgttgctgccccagagatcaaagagcaagccaagtcggtgcctccacatgttgaaacaagatggatgttttgagggaagccttccttatagaaccacctcgcaacttttgcggtgagggtgctgcctgttgaagtaattgttcgaaggctagaaaggtcgatcaaatccctcggctttaccccgctatccatgagcatggatagaaacttggccgatgtgccaagtacattaattctgagtcgctcgaccagcctcagtagaacaagagagtcgggaacaaatggtgagccgtcgtagacaacaacacggccaccaaaagacaaagagaccagaaccatggcccacatgatccaacccgtggttgtatactgcagaatagtgtctcctttacggacgtcgtagctgaagaaggaatctttcctgacttgtagcaataaacctccagcggaatgaacaatgcattttggaggaccactcgtacctgacgagtacacaatgaatgctgggtgattgaaaggcagttgcttaaatgtcaacggccgtccgttgtcctggtccaagaaccggtcccaagtggtcatcttgtgatgcttttccgcggggatctccctttgccctgttataacaaccactttagtgagctgggagtctttgcttaagacttcggtccactggcagtggttaggcagtaggtctcgcagcttcgcgttgtaagtcacttcgctctcgcaaaacacaagcttgggccgaatctgggtcaaccggctcaataccccgtccacgcccatatccggcgacgagcttgaccatatagctccgatggagagtgctgccaagcatatcacgatagtctccagccggttcgagatcacagccgcgatgcgatcgccctcctgtacgcctgaagcaaccatagctccggccacttttgcaacatcatcacgcagttcacgccacgttacgtttcgaatatggtctgcgccttctgaaacgacatggatcgctacctcctccgcctgataattggagaagatattctctgcgaaattcatcttcgcccctgggaagaatgtgacaggtgggtacatcgcatctgaccccttaggctgggcaactctgttagccatgttatgataccaaaatggagtgacggagatggcactgctctcacgtgaggttgcattgcggcatacggtgcttcgcttgtttttattccgagatactcaaacacttccatccagaaggcgggagctgtggctgcgttcgtcgaccacgcccacagtgattcatagtccgtgacagcagctccatgtttttcgttcgctatccgtatcaggtttttgatatggaaaccagatgatggcaacggtttccaaagcacatcggatggatgctctgtatcagagttcatggtcattagtgataaactcttagggttttctcgatgactgtggttggcagattggtacgtatttgctgtgagcagattcctcgaattcttattttccccgcatcggggtgacattattcatcatggaggtgcgtgctccacgttaggaccgttgatcttcaaggttgtatttccctcggctaatcgggatgagttagaatccggaacgagctgtcatccgggccgagggtctttgtattgcaacttgctcagcagacccaggccaggcgttgtattgtttgttgtattacctaagccttcgcagtgaagacgaactctcctttcgcagaaggctggtacaggatcccgcagtagcaatatacttccatccgcaggcgataacttctgataacctgcggtattgacgaaatggttccgtcgtcagcaaacttggcaccacaaagctgcgtcatacccctgcccgcgacgtcagaatcctgttcatatacatattagatcgtaactgaacattaatgttttctgctggacgtttataattgagcctgcggtcgcttgcatatttggctgcgctgaaaacaactttgtcactatggatgctataggcgaataatcggcatccaaatgctatgattcccagtgattacacgttggctcttccctagtaggtcaactcggtgagtctttggtctcgatttcatgcctaagcgagccaaacttacctgcttgcatgtgatacatgttgagacacgacagtttctttccggatggtacctggggcgtgactttgacacaacggcgaccgagtccaagaatcttccgttctcaatatacgcaagtacggtcgtaaagagggcaatattgcaattattagagcagaatgagaatcggcgataaataaagcttctattatctgttaggaaatcttaataataggcaagtacgagaaagaatgacaactactcacgagcggtagcaaggtcctcgtctggtccaattgttgtctgattgatgagccatctggtgaaggtaacgccgatattgaggatgccaagagcaaaagtgatgctcgtgctaattttctgagccttggacatccgcaactggctgatcagaacaagggggaagacaaaaactatgtgttgcaattagcaagcaaaccacttgaaggtttatttatacatactccagatgtcattggcaaaatgtagcgcaaatgctatattgtcctgcaaattgaggcatgacgatgagcaaagattactcaccgtccttgaaggagattagttcagtgagatcaacaaacacgaagcatgggtatattcaccaatggcagccccaactacacaagaggaagtttacgcagactgtgacgatgaatgcggaaatcgtgaaacatgatagaacatgaagtgatgtccgaattctgccgctctgctgtgcgaacacatggtagtagagcgtgatcaatattcccttactgagatattgtgccagataccacgggaagactgaagcgtagaagacctctcacataattagcatgttaactccagatgaccaatcccataggcataccttgagcactgtaagctcataattttctgacaatacccagccagctatgtagtagtcgatattttcagaccacactccccgaacgtacagatatgtatcagtgcatgtcaacgctgtgttgcataccaaagtggcgaagatgaaccagtcactaattaccaacccaattccgatgtaattaaacctcaaatggagacgtgcaaggacaaggacaatggtaacagcaatcatcgtccactcgaaggcctgagtcctgattagcccaaaggagataaaagaaactctaactagaggtgccagtgatacttaccaagagcccctctcccgacaaccccatcttgaccgagaagtcaaggtttcgaatcggacatgcaggatatgaaaacgaaaatggcaaactcagttctcattcggggttgctctggtataaatttcatcaggtctcataatgcactcgtcaaccattccgattgcagtaaactatgttatttgggttcgcctatgattgtacgatcagatatttgatgttctcaatgtctcggaggctggaatgctgactttcaattggaccaatctgatccagttctgtctcgcccaaccggctctggaatgtgtatgcactcgcaaaatttcgtaattggctccagatagtggaagattggaaacatccaagcccgaaggataagaaagatttattcaacgataaggcaagttgatacgtcattcagtacaccttggatgaaccagcctgaggtacatcatcgagcagcgatgggaaacaaaatcgttccaaactcaactaaacggtttcaataattacctatagtcatgatgtgtgcatggtcttctaactcttaacacaccatgatttggcctgtgaggttgaaatctgtgtcctccgcgggcattttgatatcaaaataaccggccgccatgaatcacaggcatgttcaaggttcaaaacagcagactccatcccatgaaattcatggacactccttgatttttttttaactatgtttagtattcacatgcctctgtagtcttcctcttccagataggaagttttaacggtttactcaaagactgtgtaatcacgcgcatattcggtgattcttgcctttaagacagactgtcaaagttcagccgtaaattagcctgccagaatttgcctagaaaattaccgagatttgaatcttcgtgttagatcaatcgaaccacgaacatgagtactgaattgcaagggataaatggcaccacgaagccaaagccactgggtcggtccattgaccacggatattatctacaaagctccataagattttgcctgaatccaaaccctgtcgacccgctcacccctctttgataaacaagacttatgccagtaacgttactcaaacatcatatcaatgacctcaagcacatgcttgttttcttggcgcgcctatcatgttctgttgtacaggttcgtcattgataaggtgacccatatcagtgaatcaatttggcaatcaccgccgttatacaacaattccagatgtgtagttccaagagagttggagttacatagagagtggggtttctcatcggggcaacgatcaattcattgaaaagcgttgcaggttattcattttctgtccgctttttattgcaatgcaaatgactagctgttgccgccatggttgtgaatctgttctccatattagctttggcagcggccgcatccgcggcattgctccctggattaccaactgttccttttgaattggacgccgatgggaagtcatgggagttgtcgggcctcaaatcagtagtggtggacagttcatatgcggatgcgaggaatgaaaagggattgaccctcattccccctgagctaaccgactttgccaacaccttcgcacaggatttgaaggatgtcgtcggtcatgaagtcactgttgaacttggaactgccgggggctcggacaagttatttcttaccttaggcgacgaatctgagtatcttgatgtcgctggtcgcgaaacctctgaaggttacactcttgacgtgggggcagatggcgttgtcatcaccggtgccagtccccttggagtctggtgggggacgcgaacattcatccaacaagtactacttggagagggcaaaattcccttcggctcaggcaaagatagcccaggatggggtgagcgcggtgtcatggtaagttcggcgcattcgatggaagagtaagaccagttgctgaaacgagtgggcatcacaacagcttgacgtgggacgtcattattatccacccgattttatcatcgagctgtgctcttacatgtcattcttcaagcagaatgtcttccacattcatctcagcgacaatctttataataatgtcaacatatacgggtacgagcgacagatgagtctatactctgctttccgactcctttcggatgaccctgcggtggaaggccttgcgaaacgccaaaatgaatcttatacaagagaagtctgggatgatatccagagtaaatgcgtctccaggggtgtcacactgctgccagagatcgaaagccccggtcattcccttccgatctcccaatggaagccagaaataggaatgagctcggattacagtctgctgaatatctctcatcctgacaccatcccaaccgtgaagacaatttggaagacgttcctgccttggttccagagcaagacggtacacattggggctgatgagtacagggatgaatctctggatgatctgtaagtcgacagtgaatcaacaacatacatttatcatggatcaagtcacttacaatggtcttgtagagcacttgctaaagaatacacgacattctgcaatgagattaaagattttatcaaggaggaatctggaaaggacatgcgcctctggggcacatttccgccctccaaaaatggggatgttgaccgcaacgtctcagttcagcactgggctaactttgaagcccttgctggtgaatggctcagcagcggttaccaggtactcaactcatgggactctgtctacatcgtaggaaaatggaaccagtggtatgggcaacagctcaaccttgatttcatattccacggagcgccggataaaaagcctttttctccgaatatctttgattcgagcaacgccacggctaacgcgaagcgagaggatgggagaatatacggtcacatcgcaccgcaatggaacgactacggacccaacgccaccacggtattagaggcgtattacagctggcgcgatggcctcgctgctttggcagacaagcagtggggaggggagttgacggcggatgagtacccaggtttgttcgcggctattcatccccatgttccagcccagaacctagatcgtcgagtcaaaacgaagacttcaacaatcatcgacatcgacttttctaatactcgctactgcgaagggaaattcagggattcgtctggcaacgggtatgacgtgaccacaaattgtgctaataccgcagaaggcgttctgcttgagccagggtgtaaggcgacaactccactcgaatctaagggcagaaactataccctttcattcagtgtcaagcccacttcagatgcaaagggacctatatttacgggcagagacagtgcactgtggtacggcaacgggaccgtcgatagtgtcatgatgttttccggcgaaagcgtctacgccctcaactacaccttcccagttggggaatggaccaacgccacgttgagagcacaaggaacacgaacgtatctagatgtgggaagtgatgcttcaagggagttcctcacagtcatcggatggactggggacaaatttgtgtgggacaagatggcctttgaagcacctattgccaaaattgggggtggggaattccagggactgattagtggtctaaagctggttgatactgacttttgagagcaacacaggggagcagaaggttcgcatgtcaatgtcaatgatatctcctgacttcatttcgtgctggtaactctttctgaatatctcacagcgagccaacctttgtccaagagctaatgggggatttatatcgcgagtgactagcaatcaattattaatgatgccaattgtcttctgggttcaaagttgatataaggtttagttgcatacaatcaactcgtagaacattctaatgcttaaaggagtgagtagacacccttgtctttaaacgtagtccccaaatacaaacattaattcttctctcctggaattttcacttcacgatgcctgctagcgtcaagatacccagtactgacgcaatcggttgtcctgagtcgcggccaattaaggttcttacaaggctgcgtctctgggaaaaattttcgtagcctttcctccagcacttggccactctacatactagcaagccaaggcctgactggtgtggctgtctgctgactcaatggtcaaaactggagccatcccagatgatacgactcctgacactacaggcagcgatcaatttatttatactggagaccgggcaggcgactcttttcctcaaagagacggcgcttttgggcaggtcactcggcaattcggcacagtcctgcttagaactgctttgagttttgatcaatccccggttgtggccaatgagctacaggcaaactcgtagccacaaggtgtcatccttgtttgtatgaccaacggaaacggcgagatccgatggttaccgtgaagctatcactttcccagcgagcacgcaatcgacctggtctcaaaggatgacaaccaaagtttccatgatggcgttgataataaggagcagaatgtccttcttcggttcttcgaggacgggagaatatccaagcgccatttcgccgccaaagttagttcgggagcctttgattccagaacaatacctccctgactaatacagaaggtagcagtgggcggaaacgaggagcagagaagatcggcagcaagattccttaccttctgataaggagtgacatctgagcctgagacatcaagcttgataccaacttggctccgtgacgggatcattgagggagacctctcaccctcatcctcaaaatgacgagatctgtggagaatttcccgggcgacaagtggcccaatgagagcaatggagtcgtcgacgaggagggatccccccgccacgtccagcaagaccgcctacgacgttccctgtcggcgcgacaggtgcagatgatcgcgattggcggcacgattggcaccggattgttcctcgggacgggaaagtcgttggccacgggtggccctgcgtctatgctgatatgctacgcaatcaccggtggaattgtctttgtcactatgctgtgtctcggcgagatgtccgccttcgtgcccgtagccggcagcttttgcacattcgctgggtaagtaaatcaaaccttcattcctctcttagtacggttcaaaactaaatgcatgaacaaccaggcgttttgttgatgatgcgtttggattcgccttgacctggaattattggttcaatgatgccgtctcaacagcttcagatctagtcgccctccaacttttactggaatattggacaacgaacttcccaggttgggctcttagtctcatcttctgggttgtgcttattcttgccaatatcatcactgtgcgagcatacggcgaggttgaatactggctcagcttgctcaaaatcatcaccattattgtaagcttacgaaatacctccatcttggaaatgaagccgctaatatggtccaggtctttattgtcatggggatcgttgtcaacgccggtggtaacgctactggccattacatcggcggagaaaattggcacattcccggtgctccttttgtagggggtattggtggattcgcctctgtctttgtcactgcatcctttgcttgtgagtacagatcaataagctgtcgccgtgtttggaccaagtctggagcgctaacataccttagacggtggcactgaatccatcgccatcaccgctggagagaccaaagaccctacacgcaacatgccaaaggttgtcaagaacgtcttctggcgtatcctgcttttctacatcctctctattctcctcatcggcttgaatgtcccatacacatacccgaacctcagcaccaagaccagccacacatccccgttcaccattgtttttgaaatgacgggagccaaagcggcagggagtgtcatcaacgccgtgattctcaccagtgtcctctcggctggtaaccatgctctatttgccggtgcaaggttgctatatacgctagctatgcagggacatgcccccgctgtctttggcaaactgaacaggcagcaggtgccttgggtagctgtcctcgccacatcgctcattgccggtctttgctttggatcaagctttatcggagccggtcagctgtggtcatggctccaaaagtatgttatctcattgtttcttataatactctctaagatcaaattcactaacttggtctagcatcgttggtgtctcgaaccaacttagttggatctccattggaattgcctcgatccgtttccgctcaggaatggagcgacaaggcaagactcatctcttacctttcaagaattggacgtaccccgtcggaccatggatcgccgtgcttctcggtagcttccttgtgctcgtccaaggatggagctgcttcagtcccaaattcagtgctgtcgatttcgtgagcttttacattgagctgcctatcatgctcctcatgtttgtagtatggaagctagtgaagaggacgaagtttatcaagctggaagagatggatctcgaaacagatgtgtatacggttgatgaagaccacaaattagaaccggaggacgagaagggttggaagggcaaggccaagacggttttgacctggttcttttagcgtatttcatccttgtcacgtcgaagtttatataagtaactctcctctagcctttgattctttcgtatccatgtgaacgtggtggtggtagaatgaggagtggtgaatttcacctcatgaggctccttgtcgggaattagtgagacaatggaacatcgaccggtgagatggccgagttggttatggcgtcaggttaaggctaccttagcattcattcctggtggagcaatcctcctgggttcgagtcccagtctcatcattccttttgcatcgcatctgcaggaaaaagttttttgcattttgccgtgtcgagaatgattttccttggtccactacggcatttgattttagtttctagtcttgtcagagcttttactatattttgcacgagaggtcgagaatcgatagctgcctgcttttcgttattgttttttactaccctatacacaggatattacctgctaaaggccgagtcggcgagatatcctgttatttgtggcctcggtttaaaggtaacatttagtctggcttatatttagctgacatatgatcaaattgcttctctatatagtaagttgttatgatcatgtcatcaaagagatggtggcatcattgttctggttatcatcgtggaaagcctggacaacccccttcacattagaacttagaaaacattcacaaacatgagtttaatcttcgtttaaatcggaagaagtgttctattgcattaacgtcagttctctatttatcttaggcacagtgtcgttcatgtcgttatctatatgaaatttatctcttagaaccctcgaacgttcattcatcattttcgcattaagcaatcaggccggtgtgcctattttccacccaactttacgcaccctggttgttgtaacaaaaatggtgcagaaaaaggttgccagcgctgcccagatttcagccacgcgatagcctccatgttccgccgtctgtatcgctcctccaataggcggtccagtgagggcagcaaatgagatcacggtaaagaacatgccgagcctcgtgccaaccatgtcaagacttttggtgatgctagccaacccggtaggaatcagactttggaatccaccggagaataggccgtagatcgcggcccagatatacattccaacacgatcagacgttgcaagccaacagaaagccatgacggtcacacagcagcccattataatcatcatattcagcggtccatagcgacctgccatcaatggaataacgagtcttgcagggacaccaactccattgacgattgtcacaaggtaggcggcttccgagtacggcatgccgagaacttggatcccaaaggcgccaatctatttttatcgtaagctcaggagagatcaatagaagaaaccatttacttacatgatagaacgtgtaatacatagcccagttgaagaagaagagcccagcattgtagctaagaaagacggactccttaaaggccacccagtcaataatggggccggctttgcgtggcggcagcctcgacttcatgaggcaagcaaccagggcgaacccaaccatgtgcacaaatccgatcaagcgcatggtccaagcaaagccaagacgagggagaagaccccgtacaaggatggggtaggccagaccacctatcgagttgcccgtcgttatgatacccagagcgatggccctgcgagagctgaagtaggtcaggacgaggccgaccgacggcgtgaacaaaataccacctccaaaccccgtcaggatgccttgtgtgagaagcagctgccaatacttggtggcgatactcgtaagaaatattccgacgagctgaagcacggcgccaacaagcagtgccggggtaaagaaaccggcatccagcagacggccagagaaggcgcccgtggaaaatgtaagccaggcctggaccgagccaatccaagagatcgtggatgggctttcaggaagctcggagatataatacgcctggaacccgccaaaagagttcacccatccccagctgatgaccattacgatccagcccatcgcgacctgagtccatgcttgggctccgccatcggggggctcgctagttgggggaggactggtgggggctggttcctcctcatctctggtctcgacgttgcgaactgtcatggcgaaaatgggtcgggtgaatccagcttctttgctgaaattctcgtagcaagaccggccagtttagcaatggcgatattcctgcctcttccccttatccgtgaggtattttcgatttccgtgttatatgcggcttgtccgatggtggagattttaggttccacagatggatttgtgacgaaatcttcagcctaacgttaatagtctatcaaaagatacagggggagagaaaatcaaatgcttgcgtatatgattacaaattatcttcttgcttaaaagcttcccacttgaagagtgcataaaaggtaacagtgaactgcacaagcctctttggaccaactcagagccaactgctccttcttggggagaaacagaaacggttccaacatagagatttagctatcatttcgcaatgaaactgtagaacaaatcgttgaatttgggagaacgtgctccgagctctattcaaccaagcaacgctttaatctcaggcgatggattgtggcttttagcggacctacagtaggtcgaaactatcttcagaaactggccgacgaaaaaccaactatcgttgcacggggagtcatataaatctaaaccgggcgaggctaccaaggcctaaattatcaacataaatatgaccaagccggtgaaaagggcggaaaaggggggggactgtcggaatgtggacgtcgcttggaagtgggagttctccggcaccgacagcacttgatcgtttctcccaattaagcttatttgcaagctttttacgctgacgccggacgcgttctccgcttaccagctgcacatatttgttttatcgtgttttgctcatcaggcagccgcaaatgtcgcaattacctccgagctcagtggagctgtgattcagcaattcttggcagttgtcagtatccttgttagcgccagcaactgagaaattctcagacttgatcagctgagtgcccagcagacaggactaaactatagcttgaaaagctctttgatgagttcatatttgatggaattgttacatgtgcggaggagaaatgggctcggatcgatacggaccaacagctacatgaacataatcgttgaaaggtagggctatgagccaccaacctagtatgcgtacttgttgttgggctagatctttccttgatcttcttacctagggctcaagagggttagtctagatttgggggtgagatgattcattgggcgtgcatgcatatccgaacgtcgatgggtcgattgtacatacgggccatggctatctccgttgtcggatgcgcgttgatctgtgccggtatacgctcggatcaattgacattaagagttatctgcgtcaatccacttctgcactgttgactttaacagaaatggacaagcatactgtgtgtgatacaagtgagtgagccgcctgggaagtgggagcactaatactagaccctccccatgtcttgttttctcgccgctgcaggaagttgtcacatggaggttcttctgcatactccacccaccataagcaaccttatcggttccacattctagtgcagctctgtttgctccctaggcagctccaagaggatgatgactgaatacggctctggctggcccgcagtcctcagacttggcgtccgcagtgtggaacagggcttggtcttggctccggccctgcatcttatcaatcttggccatttacagaaggttacagaatgtagcccggtgaaattttgtgcgtttggcattggacctagatgatgattgctttagctagcggatcgttcggaggctcgccttggcccttgaacctgatatattcaatgaacaactcgtcaacaataccgtaccttattgtgagactcctatcacattagtgggcgtttcttttctttttgttttcccttggtctgtgaggttgtcttcccataaccccattcgcttgtccctccactaagccaagcaattcgaataaccctaatgatacccttattccttggcaaacttccgaagtgggagatggatctcggattttgaaagggaacacctcacacgtggtggctcaactctcccgagattacagggttcagatgataatcgctaccactctcgcaggaaacccgtcggttcgggcggccgccacagacatggctaccatagaccttcttggcgatgggaccaggtaaacagccgggccaattatgtccaaagagatgaaatcggtttgatccaggagaagcgtatcggcctaattccatcttctgcgtgaatttctgaaaaggctaccaagtatcaatgatgaggattactaaagtatatatgtccatgccgccatgtccgtgagacagaaatgagacgttgaccaatactactcagctcagtaggctggtttaaacctcatccgcaaatctgtgtcccttcgcccccccttctcagctgcgattaaacatgtccgctccccaagtgcctcttggcctcccagaagagaagaagacggctgtccccgttgtctcagttccattggaggaagaaagcatatctcctgagaatgaggcagttcagaaagtgatcccgtggacttacaaatggattgcattagcatgtgttgttgcctttcccatcggacaaaactggaccaacgccagcttaggtcctctcaagaacacactccgccaggaattgggcatcacaaatgcccagtttggagtgattgccagcgctgattcatttgtcaactctatttttcccatcctggggggcatgatccttgactggtgggggcccaaccctgtcaccatctgctgtacagtcgtcatctttctcggctcggttgttgctgctgcctccatccatatctcggcttggcgtatgctggtcgctggtcacgtcatcatgggttttggcattgccattcttgatcaagcccagcagaaggtgagacacctcttcccgctcccgagcaacactcaggatacaatacttactcctactttttgtttgcatagttcatttatcattggtttggtgccggaggtctagcatttgcctttggtcttgagaatgccatatctggtgttgttggtctcgtggccggcatggttgctatcccgatccgtgacagtactggctggtatggctggacgttctgggtgccggctttcttctgctgcgccagtatgctgatcaatatcgcctacggatttttcgagcatgtttttatccccaaacattaccgtctgacgtctgccagagccaaagctgttgcaaagagtcatggcctcaacgtcaagcggacattttcctgggactcgcttttgaaactcccctggcagtatctcatgcttcccggaactcagattctacaaagtggtggcgccaatgggtttggtgtttcggcggcagatatgatccgaatgaagggatataaagaggacactgctggcttcatgaccacaggccagaaggtgattcgaattgtgggagcccctattgtcggctggctgatcgatagatacggccatcgattccacctcgttgccctcgcacccctcttttatgttctcgccaactccctcatcggtttcacgagcgcccatccacttgtggcacttgtgatgcagtccatcgcaggtctgatcaatggcatgcctctgaatgtcagcatccccctactggttgccgaccaggacaagttggggactgcttttggtgtctggagggccttcaacaattccggtgctacaattgtaagactgaacttacccaggctacttcttcgcttttgctaactgtcagttcagatggaagttgtatatggtgtggttcaggacggcacagaagcaatgggttatggccgagtcttggttatttcatcatgcatcaaagctgttggtttcttcatcggtattacgtatatcattgtcgacttcaagaagcttggaaagggtatcaccatgacgcgatctcagcgagaggcacgggagtctgagattgaggacagagacgccgatccacttacgaggaggagacccgttaaggcatggacaatatacgtcatgtgcgctctggtggctatggttgcaactggatggactctgttcatcaaatatctcagctagaaccagatcatctgtatactgtacttctgtacttccaaaagcgggcatcttgcttttgccaggcatcttccaccgaggggtgctatgcagccttaaacttcaacttgggtctcgagatggaagatgagagtatcaaaataaaatcacgctattcagtctcattatctcttcttctatcttgaaagctttgcagttatgtgtctcgtatctattttgccagatcaataagcgaggaattgggaagcgccttgtcaatgcactggtacttggctgggttttcttgtatttttcgcgtgacaactccaagccttcgtacaccttccatgatatcatcctctgagacatatgcaaatgtcaatctgatgtatttgtcggtatcaatttcatgtttgctgtcctccacttggaacatcgtaccatttccgatgataagcatatcacccatcgctacttcggagatgactccggatgaaatgccgtctggggttgtcaaccaagcgaaataccctccgtaaacgttcccacccagctgtcctgcctctcgaagctggaagcctaatggaagaagatgggtatgaatcgcatccaccatgatacgatgtctgtgctgcaaattcggtcgcaccttgtctgcgaggtgtttctggagggtgcccgtttcgatcatatctgctaatatagatgcacagaactggctcggtgagccaccggacttggtcgaacctgtttgcgcaagtccaaacgcaaaagcagtcgagccttcaagccatccagtgcgcattccagggccgaccatcttgctgaatgatccgttgctgacggcgtgtccgaagccctttgggtcattaggggaaggctccatatcaagatcgatgtcgcagagtcgaggtagaatcatttcgggtgtctcatctggcctaatggtcggtttgtctttctgatcaatcggccactgaagttgatcataaacgtcgtcacagacgacgagagcatcaaacttgcgtgccagcctgacgagtccttcgcggcgcttgactggcattgtcttccctgagggattggcacacgtgggaacaacgtagatgatatggcgataaaacttgcgatgcggtccgggctcttttactggaatctgtgtttcttcttagccactcccgggtcttaagtgctcggatgaaccttcttgtcagatcataccttttcgccttgctcatcttgctcttcaaactggcgcatcttctcctcaagcacttcaagattcggcccctcatcatcttcaggaaattccatcaatctatttttgaatcccgcatcgtcgaatatagcaaacacgaggtggtaagtcgggttgaccagccacacagcacgcgtgacgtttggatctgtgaaactctgtaggatgcatgcgatgttctggcttgcaccgccagaaatgcaaattcgttcggggtcacgcgggactctgtagtgtgaatgcagccatgttgcgagagcttcacgcaaaggctggaatccgggatctgcgccgtattgcagggccggaatgaagacctcgggatttgaaagaactgcctgcgaagaagcggacagtagatctttgggcagaagcccagggtgtggccagccgcgcagcaggttgatgaggtgaagagctgctttggccatgataacgaaatcagcgcaatgataagcaatggagtaatttgggacggtgttttgggagagagcctaagcagagtaaagggtgggtggagcgcttttatacctgttgcgggagggatggccagcaagggggaggtagctttcccgcatacactcggcactgctcaatgttggaaggcttctccgaatctattacaaattgtttcatgcttctgagaagctgaatctccacctgaattctcaaaagcccgcgttaagcaatccaactgacgccatatacgcaatcgctcccacactgctttggcgtcaccacaattagaacctaagagagaacacgaaggcgctttcagcatagtacagagaaatgagttttatgaaaattacgtgattttctcacttttgaggttatttagtgatgctgcgatcttgattgacttttgctctcctccaaaaaattacttcctggagatcaacgagcggcagacttcccatccccagctcatctccaactctattagaatttaatcacctctatatccctaaaactggacatggaattctttggaagaatccatacccagtgtccgtatagccaaaatagtccctcaaactatcaggggaatctctgtcgcaggcgggtgagaagagaaggcttctgaggcgtggattcctcttcggccttgagatcctccaacccggttgtgagatcaatatcatgcagggggtaacaccaagtatctgatctcccagcagtgagccggtgaccaaaatacagtatcaagaatatggggattccgatataagcgctgaaaaaggaggacaccgaccaagaggacggcaagaagacctcaaatccatttatcaagcagagcaccgtgaaaatcccgatacatacgtaggagctccagggctgaagccaggaggtgtatgggaggtcctctcttgggagcccctgagcggcgaatgcactctgaaatcggattgaagtctatagaatttatgttagtctaagtttctcataatactgaaatcagacaggactcacgatcgcgcagcaaatccaggaaatgaatgcagcagtgttcacaaggttgacaaaccagctgaagacctcacccgcctttgaattgacattcaagtacgccagcagagagaaagcggagctggccaagacagcaacataaggcacacccttcttcgtgcactttgtgaagatctttggtgcttgtccattaagtgccatcgagtagagggatctgctagactggaagatgaatgcattgccggcagaccaggcagatgtgagaattgcagcattaatcacactgtcaagtcctttgatgccagctctcttgattccgagcacaaaaggtgatgagccagcacctgaagtgccgttggtgagctccttctcattagaaggacagataacaccaattgcaatgacagagccaatatagaatacaagaatgcggataataaagctctttgcagccctaggaaggttgcgacgaggcgatttcatctcaccgcagcagaaaacaagcatttctggagcaaacgagaactgtgtttgaccctgtcagtgaatacatataggagagaatctcaaaaagggggacaaacaggaagaagtgccgagatcagcgtactccagaagctgaccgcatagcctgccgagccctcgaggatgtaagtattaacagcacccgggtctttccagtagtagaaaccaagccttgggtttccgggtcctccccaccagaagatcacgaacgagaggatgagaagtccaatgattgtgatgaccttcagtgaggcgaagtagaattctgtttctccgtacactgagacaggtagaaggttcagcaccactatcacagcgagcatgatggtaatccagaccgctggattgaccggcgggttccagaagtcgataatcaaagtggatgcggtgatttcgtaaggaacgaaaattccctgttccatgaaacatcagttatcaacctttctatcagtcgaattatggcaagagtttcacctacaaatgcgtaccagtaataccaacccaacgcccagcccagggatggagagacgtaacgtgtggcaaaatacgccggcgtagcaccttttaccggcctattgcggtttgaattagcatgtatactgtgattggtcctctgtttatactcacaaatacgcggctgtcatgatgatagatccaacgatcatatacaccagccctgacatgagtatataagcgatgagcatgaaagccggaccaccctttgcaagagtcacaccactgcccacaaataaggcggtaccaatggtaccgcccagagcaatgagctgtgcatgccgtgatttgagaccacgtttagtcatgggctcttggatttctccattggaggtgtcgctcgttgaatgggcagtagactggactgtgcttttttcaggagcattactgccacccaaattttctaatgtggtagccatgtcgagacgaagtctgacagatccagaagaaaggattgcagaaagatcccacgttgattcatgatcgaaaattcacggcagcagagtaaatgataaatatcttgttgggagagaacttgccggagaaatctcgacgagcgagctttaccgtggagactagatccaaaaccaaagataagggaatcgtgctcgctgactgcttccattcttgctagcttatgagtctgtggagctcggagatatccatgatttggtttccctgttcagtgggtcggttcctgactcaagtctgcgacgcaggattggtaaccaatggaaacgtgatgaccccagaacaagaattataacttggaagcctattagtattcgggaataatgaagccatgagataaatatcgttcgataataagccggacgtcagaacggtgaggagggtgaaaggaggttggttctagccttcccttgcatcggtttccacatggtccgacaaagaagatcaaggcttgctttcttggttttattttcatgatcagcccaactacttagtaaaagctccaagagttccagactactatgtaacagaagtgtaatactgaatctggggaagtccaactaagagtacatgttaacctgtcaaacccccccccccatcatcttagtttccaagtcatcaaattgcagccgagtacttaattgccatgtgtctctggccggctcgtgtcgggaataagacaacagctggctcggttcagcatttgcaaggccaattactcgcacgcttggctcagtgattagttccattacaaatatcatcgtgtctttgaatccattagacccttgattccccgcacgagaaagcatttggcagatgaccgacccacacctcgctgactgcttccctgttaaaatctcgctgactgtttcctcaagccaaccgagttcggggtgcctgataacgacaatattcatgctcttcaatctatcaggcacgccaacgaatatataagtcaatagcttcaactacggtcggaaggaattgtagcgtgattgataagaaaatagtcatacatcaagactttctatcatggttcagcgcatttctcgggaagccggcctgcaggccttcattgacgccgtcgagaaagacgggtgcgttatcatcaaggatttcacagacttcgaatctctcgagcaggcaggtagagaagttcaaccctaccttgatgcttccattgcagatgctggaagcaccgtgggtgccctgaatggaggaaccgccacttgcactcggctcgtagggcgaagcaaaacggttcgggagaagttcttctccgactcgttataccaggtatgcttacacacatctggatctctccaaccgaaagtcattctctaattggtaattctaacagagtattgccgaccattttatcggcctggagacaaagatatggtatggatccgaacctaccatacagaaatcaaaccccctcctctccatctccatcacaatgtcctcgcagcccggctgcaagcctcaaaggcttcaccgtgatgacaagaaccaccaccatcgacaccaacaggcgagtcaatactccaagggacgtgacatgctcattgggttgtttgtacccgcatgcgacactttcaaggccaacggcgcaacacgcatcatcccgggttctcatctctggggtgacgataagcctgacttcggagatgatgggaacaagggcgttgtagatgccgagttgaagaagggagaggcgtttgtcatgctgggcagcctctaccacggcgccggcgagtatacactccagagtggctgccgcacggtgcatatcatgtttatgtgcagtggtgtgcaccgtcaagaggtaagtcttacatgttccgtcacggagaccaattgctaacagtattcctaaaggaaatcccatacctgagttatccaattgaagacgtcaagacgtattcccagcttgttcgagatcgactaggatggaaacaatctgagccaaatcttggatgggttgacctcaagtccccggagtttttattggaggagacatcagcgtgacacatacagctagataatagaggtccatagatgaaataataactatgaaatgcaatgtgccggctccaagtaagcgagcgcctacagatggtgtaaaattaatccgaataaacctgaaattatatctgaaaaatcttattgatgcgtaagggcatgtacatagcatcttcttacgttccttctctatcctggtctgtcccctgaagttatgaaatagaggttgcctcggtaagcaacaacctcgattgaagaatcaaagacatttctgaaaaactaatcagtgcacggcaggctgtatgaaatttaatatgcaatagcatattcttacaatctcctaccaaggaacaataccccggccacgagccctctgagaagtccttgcgccaacaaccaactcctcgctacacctcatatcactacgtcaattttcatgtgagtcccatatataagtgtctttgccttatgttcaaattattagtgaaagtggtatcgtaatgttacaaaaagtctaagattagatagcaagtatcctcgtccctctccttcgtaaaacaaccgcccaatacggctcgccatcatcaagctcactgtcctgcagagcccaagtttcctggacaacagtccataaatttgaaatattaccaatccgatactcgagcatctgattccaccatttggcccagaccgggcggtcagacgcgctggcctggcacgaggcaatgaaccctggccaggaaatggttgcagtcgggatcacattgtagcctgtgcgctttttaatgtcctcaatctccgtgagctgtgaggcgacactccgcacgaggaattggagcgtatcctggtcgcaggggagcacgcgggtgtgataataaatccggatacttgtagcaaatgccaggatatgctttgatattagcagaagagtaatatcgtcactcttggaaaatgaaactaatggctcctggctgatatgccactccgaaattctggccaacagctgttcacgagcagccaaaaactcgtcggggagatctgtgtcatttgatctgtagtacgcagtattccgtgccagaatacacgtttggcgaataaagccagcaagtttggcagtgacgccatatgtaaactccaatgtgctgccatctccaaggaaaagcggcgcgttgtagatgtcgcgtgaccacggcaaaggctcgttactgacgtctaatgaatcgctcaatgtacgaagaaagtatgagatgttgatgaggtgctctgcttgagagccagggagtacatgctgccgaaggtttcttacaagaccttttgttgcatccagatggatccaaaattcgttcatttgcccgtcaagaacctaaagcttgtgagcaagaagctacattcgtcggagttaagaaaactcacgtcggctgttaccagggttagcatcacagatagcacaccttcgtagtcagagagggatttctctgatgatgattggccggaggaagtctttgggtcaaacagcgacttcagtgccagttgcaggtgtgcttgtgctttcaagcggaaacttgtggccaacgcatccgcctcaccaaacctgtcagagccgcgaaggaagaacgcagatgaggtgaggagcgcgtacaacaatgccgttttgctattcaatgcgatatttgacggtccgaggtgctgggtctcattctcgttcttggaggatttcaaagccacagccatagcttgcgtagcatatatcgagctataggcgttgccagagtgaactacaggctgcaggacagtggcgacattgtgcacatagttgtgcattagttgttggacaagaatatctttgctatcttctctgccaagcattgggaaggggttaatgagtgaatggcaaatgtgtaagatatcttgggactcggcggcggggccagcggtgtacaaggagagggcgttttctgaatgggggtgaacatcttcaatcacatcatcctcttcgatggaagcagtttctgtatttgcttctctctcgtcaagggcctcttcaaatatctccggcatcggagtatcctcaacgggcagggtatcaatcaaggaggtggagggttttgtgggcagttgactccgagatgtgaacactccaaagggtccagacgcgtaggcttcccgagcctcggtggccttgtacccatcgacatcttgtaaatgctcgtcaacatcgttgatctgccctgcgcgccagtgtgggactccaactgctcatcttgtaagcacgtgctgcgacgaatcagggggatgggggtcaagtacgcggtagcttcatagcctggcgtttgatggccgagggggcgtgagattcctcatcggtgatccagtacagcggcacattgtaaccctgacattcgatatttgctttgatgcagcggtggcattttgggcggctggcgtcgcacttcactttcctggatcggcatgtccaacagctgcggcacatccgtgattagctctctacccacaagtcgggtgggtactcgttaattaccctgtaaatgtcttggttttgactctttttttcgaagacgcattattaccactcataatcaccaacaactcccatattctgggagggctcgttgggagtgcaggctagaagaacaaatagaatcaagggttgattgttgcggaactcgcgccattgttcttatctcttatcagttcttatcgcattcgtcgatgatcacgtgatgaggcagccatataatcagcttcaacaacattccaatacccactttgagaggcgtcaactcataaaaggcatcattcatcaaatcgatcagcattcaacgagtcctccctattttcttacatacatcaaaagaggtacgagtgacataatcccatatgttctaagcggctatatacccttgtttatgtctaattgacctaattctcatgcgcaattggtaggtaacggctctagggtaagcaggcagagagcgaccaggtatgcgctagtcttaaaaaagcgaatattatctttctaagctgataagataaacttagctgcctgtggctgggtcagttgctggtgatgtccaacttcccagccaacggcgttaggtgtgatgattgcgacaggaccaaagactgtattttcttaggtaggcccggcattaagtctattttttgtcttacacttacgctggctcctttccttgtcgggtttctgcctcagccatgctcccaactgcttctcgcgctgccgctattgctccctcgctccacaatgccgtgtctttgctgacttcgttgaatcgatctttccaaaacttccagcgcctatgagataaccctgggttgccttggaacaaagttccagtggcaacatcagtaccccagtcaaaaggttctggttccttgtcttcatcctgggcccattgcagcaaccttgggccagagtgaataacccactcgcttgcgactagtatgagacattcctgattctcggcttgatctgcctctctactttcttctagggctgctcgcagttgccatatcccgaagtgtgcccactcccctacacccgctccaacacatcgggcggcgaaggcattttgatttcgccacatccgtgccgattgtgcatcgataatctcatcctttctaacggggtctttgacgttattgttagctggaaattcttggtctactttacattcgacgatcagatggggttgatataccagtccaggtttcatccatgaaatttgacagcaaagggagatctttccacaggcgccactcactctgaaacggaacaaatgttagtgttgatctacacccttcgaatgctaagccgactcaccccccaaaggctcacatctcccttcgcacactgctgtagctcaaagagaatcgctacaagggccccctggcctggtttatccgagtcgtggggcagcgcctgagcaacgtccaagaacatggtccaaagaatccatatataatctccaatatccctggacttggtaggaggacaaaggaggtctaggccctgggcggcgatactggcgctccccggacttgccgaattcagggcagtctcgataacattcagaatggaaatggctggctcaattagactggttgctttgatctcgcgtagatcgaacttggattgaggggcatgcttttcggatttgacgggatttgattcctcctcttcaagactactctgaacagtcttgtttagttgagacgcaacatcagcactgcgtgagctactttcaagctcaatctttggcctgctggcaacatcctcttcaagtccctcctcgccggtcttgtggttattttccatagatcaaaaagcaatgagatgaagatgatgtgtgaagatgaagttcagatgagaggtatttgacgatctcgcgcgctcgcttggcgtctgatttgttgagtagcaggaacagaggatggattgattgatgatgttcgtactttgcctaggtacggaacggaatgagactgattagtaaaaggaatttgcgaggacacgtgatgagatggaattgatgaacttcgtcatggggtgtgtaaaggttgtgtttctcagccgctgggttcggctctcaccatttcatgagctgagggagaaaccccacaacctcctcttttacgcgccgcctcgcaagtcctaaacttgggtgttgtaatgcgtgtaagccgtgttattaaacccagcgcttctggggcttggctgccggccaccactctaaaaataaatagagggcggccaaccaatgcttcttaactcaacatagattatgagggatgaaatagaggcactgctaggtgcaggaactactgcaggtgccctggaaattgttgctacgtaatgctcaacaggatccactacatgcgctgtcgaagactagaatgagatcctctgggatcgtttgggttttcagctacggctgagattacgccttgtctcagtattgaagctgattcccacctagtcgatacttcttgaccggacatagatgagtctgaagaagccgagctgtccagacatttcctcttaggcgctgatgcaagcatctagatcaggtacaagcacttctacacgtatctctggcaattttacgcttaataggacctcctggatgttgccgcagaactcgcgagacgagatcctggttttgttcattagctacggctgaggctacgccgcatattagcatcaaggctcatcatttgccagctcattcacgcctagtcctcgtgatatgcggccatgtgtggccgtgtgagacggcccggggcgctgaatgagcctaatattaggcttggcccagcgagttctggacataaaaaaggcgattctaccattggtatttcaggtgttgcaacaactcaatcactagcagtccgaaagcaacaccatgtcgtacaacaactataacaacaacaatcgtctcaattatcataatggttcctatcacaatcctggccagggatcatacactgggacatcgaataccaatcaaggctccatgtcattgactggagaccaactttcatcctcttaccattttgccagcgccccgccgttgtccttgactggagatgcatttgtaagctaaacctctgctaagcctgatgcttgtttcggtaaatcttcttgttctaaccccagcgatagcatttcggtgataatttgaccaacagtaatcccaccaaggtccttctcgacttgaatgtcgccagccaaatcaatgctgcgccaactcaacagaatcgtcctcctcgcaacaactatcctcatcagttccataaccgggacaggcctgccatggacctcgcagcaaccgggacggtagtgggatatccccttctcccgggctcgacaccttacaatggtggcgatccaggcacaacccggggcttttacaacgagaaccaaagggatgtttataatgtcgggtaccacgacacaacaagaccccctgttgggaggggtagaggccggggtggaggccgaggccgaggcgcaaggcccagcaatccgtttaccaatgcgacgtttataccggctgaccacgagctccccgatgacaagaccatgccggccctgaatgagcagatgtttcagtttgaccaggcgaggaacgttgactggggtgactacagtaacgaaaaccaatgctaggggagagcttctgctgtagaaggatactgattcaacatcgatgccaggcgaggggcttagttttatctgtactctctgctggcaccgacacctctaatcccctttgtgctcgtctgtagatctgaatttttcatgctgtttatcctttatgctcccaatccacacatctcatagtcttcaatgtcatttgttttccatagtcactttcaatttatagtattcctactcctcgctcatctctccaaggcgtcaaagcgtcgtaagagggggaggcaatttcgtataatttcaagcaagccgagcaccactcagcctcctccctagcatttagtagatggcatattgcattaagggggagcaccgtgtatggccaagaagtttttattcgccctgttcttagtttaatggggcgtatctctagcccgtatgttgcaaacttaaacgcgatggacggagctatcgttcatcgcattattagtgcgaacacgacatatacgacgcaactactccgtatgcagccacccacttataaagcgtgtggtgcacccttaaagaagagcaggaacctttatttctcccaactttctgagacaactgtgcattaacacgtccaaacccacaagaagagcacaatggcagacttcaaggaactgcgagcgacactccagagaaccgccactacttttatcgattgctgtaataagcacactgtcgatgctatcctctctctccgtgccgacaactgcaagcacacacacctcccctcatcacttgatatcggaacctacaacaacgcagagtacggggcattttacggccgatttgccaacatgatgaaagactgcacctgctggatagtcgatgacaaagagatggttgtggatgtcgagtcccgaaaggtagtgatgcatgcgaaaaacaaagggaacacaccattgggagagtacgagaacgaatacatgtggattttaacgatgactggagatgggaagatgattgaggaaatagtagagttttgtgattcggcaaaggcgatcgaactcatgaagaaacatcaagccaaatgagtgtctatagctagagaaagggcctttggttcggagggtggatgttaattgttggtcagggcaagtcatgttgatggaaaggacttgcgtatagctgtttcccatctgtgaggataaaaatataaccttttgttctatcccaagaagtctggaagacctttggccacaaatcggctgagtagaaatatattcttaaggatcagacttcatccactttctcaagtccaatttgaaaaaatcttggcacataatagtcaggcactagggtacaagtatgaactgtgttaggtgggcggactgaagggatatcattttgcataatcaacggtaatctgcacaaggcatgtgatcaaagactgtatttctattctagcagattatcaaatcaactctaagaatatgaaaagatcctgggtccgtacgatcattagggttggaaaacttgtgcatgctaattctttctcaaccatcggttgttgagtagcctactccctcatagtctaccgactgttatttggtttgcatggctaagtgaaatagaaaatgagcgaccaggaatggtgttgtttcgataacgactaacaccttccacatgaatgagacaaaaagtttaatcagtatttgataaatgagagacttaagaacgaaaagtgtcgccttattttgggtaacctcattgtttccccaaaagcgttattccctatggatagaccaccggggtggctttggtagccagggggacttggtagccagaaaggcatgacatattagccaaaaatgtcgccctttcgaagaaagtcgtcgatctcgttggcaaagtagtcttcgttggtctcgatggcaaagtgcccagcgtcaatgagatgcaattcgagattctttacatccttcttgaacgccttagcgcctggtggaataaagatctcgtcattcttgccccaaatggcaagaacaggcacctcggaagttcgaaagtattcctggaaagcagggtagaggtcgatgttcttgcggtaatcgtagagtagatctagctggatgtctcggttcccctcgcgctccacgagtgcatggtccaaccagtagctctcaggctggatcttctccggatggggcgagccattggtatactgccaggtgatggaatcaagctcaagggcgccctgaagtgcgttgcgatcctcgatagatccagtttcccaatacttcctgatcggagcccagaatttggttccaaaaccctcaacgtaggcatttccattctggcttatgatggccgcaacattgtcgggattgtttagagcatatcgaagcccagttggggcgccatagtcgaagatataaattgcgattttctggagtcgaagcgcagacacgaagagctctatggttgcggcgatgtcggcaaaggtatagttgtagccgtcagggacagtggtgaagccgtaccctggcagatcaggcgcgatgacctcgtacccacgagaagctagtcgaggtataaggttccgaaactggtgagaggaagacgggaatccgtggagcagcaggattgtgccttcaggcccgttggtaggcgcagcataacggtaaaatatattggagccgcccgcatccaccgaggagacatatgatgttatgtgggacatcttcgtgttttgcgtatgtaaattgcttagattcaatacaggttttattgtgattgcagatgcctgttcccgaaaaaagcgtccaagagccatggttatatagctagaaacaggtgtttacggtggtgcgatcagtgatattgttcggtcatgacaacatggtcctgcatttccctgagcttcgatctttttctggtgtatatttttaccctgggagctagtcattggcttctacaatgaaaattgagtggcaatcctaattaggcacaacccagcatgcagagtaacatcgacgttccaagggcgcgcttacaaattctatggcgttttctgggacgaatagaaatcaatacatcggcttatttcgacctctaggctactccaacgtagcaactgctgacgtccggagtgggttgcggcacctgcggaggttgcggcgctcaaatcgccgcacaacgcggattgaacacgcacctatcacggccgatgcggttctactttgttgcctcatgtgctcgaaaaagacttcattgtgtcggcgaaggtagcatctgtgcatctccgcggagatggtaagcaaaggaagaaatgcaaaaaagcatctggcaattgaattcttattattaatggctgataaaccttgtacaatgactgatgctatatcaatattgaacaactttcaataactacaagaactacgtatagacatataagtggcctgatgggaaatagggatggctacgcatgattcacagccgcgttgtagaatgcgtttgtgtgtagcagctcaagcacaccctccacatttccaactagacgaacgggtagttttgatgatcactcaccacgaccggcggattcttagattaagacgtctacctcagagatctggtcttgcggtaaagtcaactttgcatcaagggaaactcgaactggctaatgcggatgccttccgtatggcgagctttaggtttggtgccgcttgtgggaagaatgcatccatttacagaattagacaaacacaacgctattaaccattctttagtccatggacgtaaataatacaatcagtaaacaaagaaacttaccatcatggaggcctcgtcagctgactggggagccttgatcgctctctgagttaggagcttaattctaggctagagttatggtttagaataaccttatctatgggcaactctatcaaaacagtcaatttgagaatattctcagtgaaacaaacatagttgtatttcgttttacttaagtagacacagattatgttgggctaggagggatagcactagatggagccaacctcgagagtggaataaagcaacgccatttttgatcaaagatctagtttctttcttccaaatcatgccaggagtttagtctcgtcaatgcactggcataaaacaagagaagtccttaactaagatatcgtcttacggtgagaaaacaaggttgggtaagaatccgagtagaaaaaagctaacggcctggttgtgatgatgaatatttcaccattaacggcactcttacgtcatgaaaggcaagctgttgacctatttcatcccggaaatcttgcaagcctgcacgatgaaaggcaagctagctcataataagctgagggctagcaacgctcggccttcaaggtcctttgtctgattcacttcgaaacttgagaatatgtcgcacttctgtttgaagaaggtgaaccaccgcttacgcccccacattggtcattgcgcaggatgacgcctcttccgatttatccgatccttactagcagcaagattgtttcgaagatgattgctcgtagagcgacaattgcgttaccggaatatcgatagaagtagaatgggccgatcgagatattagtcttggtttaagaacacctttcccacaaccgcgcgggcgggaatggtctccaagtttggacatagagagagttccatcgctaacaaggcacgttatggagcctcattgtgattacttgtggctctagaggggcgtagtggggggattggagaacaaacgatcaaatctcgctgaataacgattgataagccaggagcagagccttgaaacgacaaagagcgggtgtataagaccgcggatattcattaccttcggtctctgatattacatttgtgggtaggaggaacaggatcatttttatctccttgttaggctgcctggcagacatcgcaggatttcatcaagagtaaaattgaatcgcgtgttttgtttgtttgttttcccgagcagagttctcagattgggtcgcgttacttgaaagatttagactcaaaatgatgaggctcaagtatcctcggataactatcgtcatatccgtcttgtcagatctctgtgcccaataaagatgaaggtaagatgaaacaggtacggataagtttcaaacgtaatgcggactatgctcaccgggatcatcgccttcaacctaagcctgagcagtcaaatatgcacagcgctcggcattcggcagcccgaatccacagttctccagacgactaatgtctgattaattccattgacaggagctcccgttcccaatgaggcagttgtgttagggaatgagtatgagatgttttatttcctcttgaaaatgtcgagacgagcacacattgcagccacccctggtatctttaactccttgagccctgtttccaattgccggggcagggaggcaatatccagattgctgggacaaggattgcaacttcgtcatcgagcaacgtcaaatgagaccttgtgtgcaaggcttaccttttgaatactattatatagtaacgacctgccgatccttttgttctagtcacggattcacaagtcattcactcattctgaggacgggagccggaatcatattcattccttagccatacactcacgtacagtcaacatgcgtgcttttactttgcttcagctcgccacgagcgccttggcttgggaagtttgtaagaattctccaaaaaatcattaatagtgtaccgtggctataatgctaactcactcgtgtaaagtccagaatgagcctgacactggattcgaggagtatctgcagaagaagggctggactgctggcacacgccctgatcttgccgatatccagggcattcctgactttgacttcgccgcccgccaaacgctctcacacgatcaatactcgttctaccgtgttggtgctggcagcgagtggggtaagtaacagttgccggtcggaagcgatatagaaaacagtctaactggatttccgattctagcttaccgaaacaacttggccgtttgggagaaggctcgccttcgccctcaccagcttgctggcattaccggtctgaatgagaccatggggtatgatatgaccgttacagttatgttgcgactaaacgttgacctatcattgcagagtgactattttgggatacaacttcagctccccgatcttcatctcgcctgctgctcgtgccggctatggtgaccccgccggtgagctcaactttgttgatgctgctgcagagaacaacattctctatatggttagtttcaccgctcctgttttgcgcttggcacgtcgctgatcatcttcattcataggctgcgtactacgccaacaagaccatcgaagaaattggcgagcagaagagaaagcacaacaacaccctcaacggcccccaggtcactttccagcaggtatatctcacaacttccgcttaatttggataaggccgggtcttctaactgacgaattagttctacgctactgatgatcatgatgccgtctgggacatcttccagcgtgctgaggcaaacaatgccaaggctttggtttggactattgatgctcccgcgacatctagccgtcagcgcgctgcccgatattcttcttctgtcagccgtcttcaagctgcagttcttgacgtaagttgacctccttgattttctgaccctttcgggtctgactgatcaacttgctgacttgatgcagtgggacttgtatgaggagatgaagaaccatacctcgctgcctatcattctcaagggcatcaccaccgtcgaagatgcgaagaaggccgttgagaagggcgtccccgccatcatgctgtccaaccacggtggtcgccaggtcgactactcaccctcccctctcgagatcgcctttgagattcaccacaacgcccctgagatcttcaaccagattgaggttcttgccgacagtggtatccgttacggagatgatgttgtcaagctgttggctctcggagtcaaggctgttggcatgggccgaccgtacgtgaatttctcatgtagttgcggggattgaagatggttgctaacatgatcatagattcctccactcgaacatctacggtttagatggtgttaacaaggccatcagcctcatcaacacggagatctataacgatgctgcccaagttggtgtcactgatttccacaacattcccatcagcattgtaagtaaatcacaatatgaggatatgaagactccgctaacagtgccaaagctcaacactcgcgctcttgagcgtgatgtttacattgtccccaccagcaactaaaggatctgccttgagttgtcagcaggtgctcggacccttagaaaatagagccatagacttagattttaagataaatcaatagaacttcatgatgagattgttgttcatatttcaatgatctgtcttgtcatttatattcgaatgaggatgattctgaaatccaaacaatacagcataaggaaggagatcggcccatgaagatgttctattccattttggaacggccgtaaggattggttaggtggaatgattttgtcgcagatcaggattaactaaagtgactggctagcactccgatctagcatcaacaccctgtagatcaactcgacaaggaagcgttacgaacgaaggacaaaccggaccccatcaacgtatcctcattacgaaagagatgatcaagccgagatggcagcgatgccctcagttcgtcttcttcgcccgcagactatcccttagcttccagaagggccacattctgagcatcataaacctgatccaaccgtagccaagtgtctctagaagccacaatttcatgcacatcgtcccaacgcgcatcgtctccctcgtcccgaagaacctgaaagggccaaaagaccacccctttcctcgcagagcctccgtcaccacctctttcgcatactcctccgccgtcatccgcttcccacctccaaccttttgtccctcgtctcgcatagaattgaacaggctgtccttaggccactcctcgtgaacaccgtcctgccctttgctagcgacaaaagatgtgacaacattcaaaacacgaacattgtaatgcgccagctcaaccgacagattctgcgaatagctagacaaagcggccttggacatggcgtatacacctttgaatgggtatcccaaacggtccgagtaggaggagatgttgacaatgagaccctccgatgctaggagaagtggcatcagcttgttggtgagcaccatcacggaaacgacattggtctcaaagacggagcgaacacgtgctggatctgcatccgtcaatggcatgatgtaccgcacgcctctagaccgctaaagtcagctactggaacgttcgagctttgttacgccattgatcttgagctcacgcattattgacaaggatgtcgagtttgcctcccgtcaactcctcaacacgcttcttggcagcatcaatgctttcttcactatccacgtcaagatggactgcggttaagcccataccggccagctcggccagagcgtcaggcttgcgggctgtggcgatgacattgcagtctattacccgaccatcgtacaacaacataattagcttcgatgaagaaacgaaatgggaggattttgaagtttgcggccaagccatctgagcaaagcgagggaagccggattctgaaacatactgcgtgattgaaattcttgagctaaagcgcagccaatgcctcctggggtacatctagtgacttgttagtaccatctcgacgttttatacatacaagctaggaatgcctacccagtaacgaggacggactttcggtgtgtctgagcgctcatgatgaaggtggtgaaaggatgaagctagatggccagagtttcaagattcgattctacatgtgatccaaccgcaaggttgctaccctggacctcggaataacaatgagccgaggtttgtgaatgaccgcatgtggcaggtagttgtgaggggaaaggggaaaagagactacaatttttcgtcaggtgaattaaataacgtctctgggaaatacagttttgtttttgaacaaaagagtattcctcaggtctagatccggagctcttgattcaagtagaaactgatccgggggagcctccaagagctagatcagagcttacaataacaagtacctaaacaaaagtccctagggatgcagtgcaagatgacactttgtagtatttggtttgaagcagaccgcggactgtcagcaaggcggacaaggcgaacaacacggataccaccctacagcagcggggtcaaaatgccccaacgcgcggtttcacctttttcaagcatggacttctgaattctacagaccgagctatatttgcaacgtccttactgaatggagcctgccggcgtagctattggggtgattggcctcgctgggctgttcaacacctgcctcgacgttgtcgcaagggtcgatgcctaccgagactttgggttcgattcacgctgtcttgcggcacaatttgaggctgacaagcttcgctttgagcgatggggccgcgcagttggcttagagcagggaaagctgtcgaccaactaccaccctagcttagccgagcagtccacgcggtcggtagttgcgcatctgatttctacgattcaggaagtgtgccggggttcggaaagcggagcttggcaatccccctcctcagagcaaatgccgggatcagatgcccatagactgacccagcatccgacaattgtatctacatccccagcgtccacacggcagaagcttgcatgggcactaaggggaaaggcgaaacgggtcgccgaggtggaaaagctgggtatcttggtccaaaagctgtatgagcaggtccctatcgaagcagacgaaacaaaaaagttgcatggatccgaggtcacgaatcttggcagcatgaggtatatacaaggttcgccatgctcattccattgtttgagttatctatcctaaatcagatgacgctgcagatatccaggatgctctgaagaagattgaacaagatattgaagctgagacacgccgagagctgtatgcctggatcggagccgacatacccagcgatatgtatgatgatctgaattcgacacgtgtgcctgggacctgcgattggatcctggagcgggacgattttcgtacttggcttacttcaatcgaaaacccgtccgtgttatgggcgaatgcagcagcggggtttggcaaaacagtcatgtgtgcacgggtgatagagcacctttcgcagacgctgaagatgccggtggcctatttcttcctgtcttccaagtactctagtcgggatgacccttatctagccttacgtgcgtggatcacccagatcatggatcacgacgagggtgctttcgagttcgtgcggaggaagtggctctctttgcatgaaaaaattgcaactaggacgaccataatatcgcttttccatgagatagcaaaggccgcctctaacacaacattcatcctagatggcctagatgagtgtacctgggtcaacctctaccaccaaaaacacgacgcggtcagcaccttcgtccaggtcatcgcaacggccatagagagatccagcagccgctggatgcttgtgagccggaataatgagtacatacgcaacagcttgtgcgattcttttggcgatgggttctttgagattcgtattacgactgatgatgtgcataatgatatcgtgtcctactcaaggagccttgttaaccagaaattatcaaataagtctcaactcgtgagagataccatctcagagcagatggctgaaaaatgcgatgggcaatttctgtgggtgaggttacaggccgataatttgcggagggcatccaatcagttgcagcttcaaagggctctcagcaaaactccagctgggttggaacaactttacgaacgggaatgggaatctattcgcacaaacccaaccgtggatacagatcgatctcttttgctgctcaaatgggcggcattctctatcaggccattatctgttagtgagatatctgtcgcagtattgattgacaacgaaatcggcgtaccagtcgaagagttacccgatgaagatgacagttcctatgtcgccagtgacattaaggatcattgcggctcactgatcgagataaccaacgatgatgaaaactcggatcagatggactcaatgatggtcaaaataactcatttctcggtgaaggaattccttctcacacatgttttcagttccggcggctctctcgaacttaacaccggtctcttggtgtcacatgaagagcgacaacatgattttcttgctgaaaagtgtctatgttacatttttaatcttgatatatgggagctaaatgctctgaaaaaaggtgtggttaaccttcaagcttcacttcttacttacgccgccggtacttgggacgaacacgtatgccgcggatcacaagataactcggatatcgtggacttggccaaccatttttttcaggatgaaactggggccttcgatgcatggaagcgatggaccaatagacaagttgttggccataaaaattcgccggaacttgatgagaatgaccaacaaaatcgcctctcttattctatgggcctgctcctacacaagactacagagcatcttctgtcaaaggatggctgcgatgtcaacggtagaggtctctttggagaaacacctttgattattagctgccgcgataaccaccttgaaaatgtgacccaactgctctcattaggcgcaaatacttcgatctcaagcgtggcgggcaatgtcccactctgtgtagcagtgagcaaagggcataacgaattagcaaagctactcctcgacaagggtgcagatgttgacatcaaggaagccgctgcgaatgaccgaacagcactgttgtgggctgcatctcttggtcatgtagatctagtcaagttgctcctagatagaggagcggacatctctttgaccgataagtttggaaacactccgctctttcttgctgcatatgagggaaaccttcagataactcagctgcttctcgaaaaaggagcagatgtagctgcaaaaacgcaacaagggtggcagcccttgaccgccgcctgtatgatggggcagatagagattgcctctcttctactagaaaacggagccgacatcgacgttaagaacgagaagggctgggcagtgattcatgaagccgtatataacgatcaaatagaaattgtccgctggttgttcgagagggagcaggatttgatcaatattataaccagcagcggctggtacccgacccatatagcagcattgaatggtcacctggaacttgttcgttggttcttggagaaacagccagaattgatttcagttacggatcctgatggttggtcgccacttcataaagccgcagaaaaaggccacgcggatgttgtcaacttgttgcttcaaaaaggttcagatgctggaatgtcggataataatgggaccactccactgcactgcgctttacataatggcgacgttaaaatagcagagctactacttcttgaggagggagtcgatgttatcacacgggatgttgacggctgctcaccgctacacttagtctgcaacagcggcaatctcgagctggcaacacttcttcttaagcaaactggcatagataaagacgcttgcgacgtcctcggctacacaccactggccgaggctgttcgttgtggccatgctgagattgtgaaattactcctctccgacaaagtcagagcgattgcacgcacagaggatcgctttggattgatccctcccttttacgctctgcgtaataaccatgttgagatcttagagcttcttctgcctaagactgaacgctggatagagtggaaggatagcctgggtcgagacttgatgtggtgggcacagcgattggggtccttggaagtggccaacttgcttgtgaagcacggtgctagaaaatcacccttatacaacgacaatgacccagggttgctcccaagtcagtcgccgcccttcgacatcaatttagcatactgtgaccactgtatcggccttattttagacgattcggaggcgtactggtgcaataattgtcatagcggtggagtttgtatctgtttggagtgctatgaggcaggtcttcgatgtttagatgactctcatgtactagcattcgatgtattcccagtttcaagagaatgatgagctgtattacatagaagaagagcctctcttcaacaagaaccatcattgggggagatgtgcaagctcctaatgctgcttgacgatccaaggcatgcagcagtaagctgcggggtcggagtaaaatgagcgagaagtatcatcggatgaagaacctgcaacaaatactgccaatgtctgcggagtatacgcctcactgagcaggaacatgacacgacccgctgagctccgcaagctactaacctcgtatgggggttcgtgaacaaattaaaacagcaatgaaagatgccggagtcaacttttcaacacaatggttaccgctaactaagcttatgtgccgaattagagctcacagtacgtatcaatgaagtgaatacacgtcggcccctatggacataatcgccgacaccaaccgtatcatatcccagccagcagtattccgtggcctgtactgtgtagaccaatagcaacttaagacagtaagttgtctaggacctggtgttcttggcttgcgatcgagaccattgaccgacggtctaccaggtctttgtctctcttcaggttaccctgcataataaccaaggaagagagcaagatatgaaggacaaccggactgtagtcgatacagatcaaactttaaaattttgggtagcactaatctcccctgtaagcattttcctgactcgaaacggatatccgtaacttagaattacctcggcattgttagaatttttttgtctttggccagctctataccgtgagatattacgagccttccttggtatcttccacgagtatggcaacaaggctttcttgaaaccatctttctctctggcctcaacaagccgaacggttccacagaacggagttacttaagtagtacgcggtctgccatcttgcctttgtaaagtaccggcgctccctcaggtccatattttcttcaaacgtccactggaatctgcatctggcatatcacctttacgaagacttcgcaggtgcatttacgcagtctcttctacaacggccagatgaaggctttcaaacactttcagcccaggtcccaggttctgcgtcgctgactatcggtgttccttctcggctatactatataccaagcaaaagtaaacgtttggcgggtatcagaataggagtcaaagatatttttgctctcactggagtcaaaaggtccaacggcaaccgtgcttggtacggtttttacccaccggctaatacaaccgggacagcagtacagaacctcattgatgccggcggtattgtagtcggcttacaaaagctgtcacaattttctaatggagaaacagcgacggctgattaggtagactaccatgcaccatttaatccccggggtgatggttgccaagatacatcgtcatcgtccgctggcgcaggatcatcagttgcctcttatgactgggttgatcttgcccttgggagcgacacaggaggttttattcgtggtcgtgctggagttcacctgttcggcaaccgcgcgacacacgggctcgttaacctcgaaaatgtcatgccattgagcccgaagttggatactgccggcttcttagctcgtgatccgatggtctgggatgtcgctaacgcggcgttgtacttcagcaactacacctcctttgtggataggagtcctcagtaccctgagacattatatgtgatggatttatcttcgaacaataactctgctacacagatgcggtggaaattcgcttctgatttggcttcattattgaacacatctatcacagccttagatctagaagaggaatgggcctcgtcggatccgacccagggtagggcacagagtctatctgtgttcctgaacctcacgcacgctgctcttatcaccaaaaatcaaacaaagcttcttcgtgattcattctacaaagactatgtaggtatatgctcttcgggaccttgcgccagatcctttgctaacattaagcttcagctgcccacgatgggcgccgtccgttcgttaatcccgtccccctaactcgatgggaatgggccgacaaacaattcgattctatccttgatgacgcggtagccaataagactttatttatgaactggtttagcgaaaactcctacctgcggaccctggttccttttttcagctccgtcacaaatcatgaagagtttctgccagtgacggtggacgtgattgctgcgaaaggattgtgatggactcatcgccaaattggccatggacttggtcgccgatgggattttgaaggccccaagaactggttcgggacttgatggtggaacaatcctattacagagaggcaattgatattgatattgatcctattttttttgcttggacactggaccttgtatgaattaatcaatgaattgtctgagaattctcgaccatcatccaagagagttgcagctcttgatgcgggcaagctgcccagttttagcacactcttttaataatctgggttgggctatccaacataccgcttctgccgtttggcctcatcaccattacaaacccatccgtgtgctcactattctactacgcacttttctcttattatttttttggggggtttttgctgtatgcaaggggtgatatcccaagatcaggctacacgtgacacaatccacacgattagtttttaaccaagttccggtccgtacccaaccttcaactctatttttttttactttttattatacggccagctaaggcacaggcaacagtaactccaaaaactctaagaagggcttgtcaagtatataacttggctatgggccctaaagggggacgctcatcatccacaatcaaccacaacacctctccaagctcattatcgccaaccacctctcacaacagcgataatggatgcctccgacgtgatcatcccctgcagccagggcccggttgtttttctcttattataatataaatgatcatcctcaatttataattaattattattatatccaagaaaatacactttatcaaagtgtgccgtcacaaagtccttacaagtctctgatcacggcgaatatcctgataagcagttaactatgcgcagctgcttcatgtgtcatcctgagcacccgtcacatgtgagagcctgtgaattacactcgtgtgctccttggtttatattaaaaccattccgcactagcactcgcaccatgctaacgcttgttgagtgactacgactacttttcccgttccttattgaaaatttacattctttcacgtgctcgattttatcacggtgactttaattatagctttttttcaccaatggagacaataagaataataatgcaacgcatttataagacctcatctgcctaagctaagactattggacgtcgttgaatctgaaccaaatactgtacgatgattcatgtgtcagaaaattccacgccctactccatcatcaaggcgtaaacctcctgctcatcagaatccgcggaatttttgaatggctgggcataatcaagtggtgtcttctcatcctttaagttgtttctcgcatacttatttgctccgcgggagagaaaaagctcaaccagtgagggggaggcggattgcactacaaaatggagcggcgtgtctccattctcctctttggccgtggctgcaagactagcatgattatcgagtagatgggtggtgatcttccgaataacatcttgctttcccctccagcggtcctcctgcgtttcatgcaaccacgcgtgcaaaggtgtgtacccatgctcatcggtctggttgatgtcatggatccttgacgccagatatttgatgagctgaactgactcatcgtccgtgtagggactggcgagggcaaagtgaagggtcgtatgttcgtgtgctcttttgtttatattaaaaccattctgcactagcactctcatcatactaacgcttctgggtccaacttgttttatgtcctttcgggagcgcagatcagaccagccataggacggcatttggccatcctcgaggcgtccggacaaaccgagaaggtattccatcaatggaacgttatccttctcaattgctttttccatgattttctccaggttttcatagttcaagaatgccagactttgcttgcgcacctctttaatgttgccaacaatcagctttgccaattccaggcttagatcctttgatcctctatcgaaaatattctcaagcatctccaagatcagctcattgcgaagcttatgggctgggcagctgttcagctgctgtcgtaggagatctacgtctccgctagccgttgtttgcggcaacaaggtgtcccaattgcggtcctggctcatcgtgggcagaggtgaaattggtaattgatataagtgttgtttttggtatgcagtgattggaaaggtaaagatgtctttaatgcaaagctttcgatatggctttctgggcggagaacgtcttggtatttatgtgctgttaatgggtcagatttcgtaatagaacagtgaatcaactgagtctgattgtgaaacaaacgatgcgccattaaattctgggtacaaagaatagcgtcttgaagcgtctaatctaacacctagtctcggtttcggatgacaatgaatggtgcaagtctggccttgtcgctctctgttgttgcattgctgtcgtttgttcattctgtccacacccggccattattctcttgatggcagtttaaacaatattttgtgatattcgaaactcaataaaacttcttaaacggcttatctagacaatatcattactcgtctcttcgagtgcaaatggcaaaagcgacctttctactttcgcatactcagtttctgggagggctagtaaagaccacacgatgtcaaaccaggacttttctctattcttaaacaatttcgcaatttatcttaggaattcgaatgttgaagctgatgcgggaacggataggtttagttcaagtgttgccttagcccaatatcggtgttctgcgttagcatggcatgaagggtatccgttaaacagagtcgtattccctgctcggcaactgcatgtctgagtttttacatcccattgctggttctagtaagtttgttctcggaactgatacgtctgttaagtattccctcagcacactcaccgcatcgcaaaaagagaaatcgcagagactaggctcttggctcagttggaaaacgcatatttcgttgtgacatgcgtaatttcgggatcctacacttttagactcctattaaagaaacaatcgttggttctaagtagttgccacaagttttccttcgtctggggatctagtttctatgtccttttcacatggcgccgcgtgcatcgatacttatggatgtttgctacattggaagtttcctaattcactatccgctctcaaaagcaaatgcgcaaattatcaagcaggaagagtcgggggcaaaatcaccaataccaaggacgaggtccaagttcaggatgacagggcaaatttccacagcagcgctacaagaggatgaccgttattacatgcaaggaggtgttcaaaacaatgtagagctgtctgagaataaaagcaattaagttaagttcgcgggcggcatagagattcagacaataacaagagcgtaggtcaaggtgatgtctagagtagcaactaaaagaaaattccttcacgcaagtccgcgactcatttactggagctgctgtcatgaataaccaccatgcacatatcaagggtccgttttatgacgaaggggagttttgagatcaatataccttgctcgaacgcgtgttcttgctcacctcatcaatacagcccttcactaacaattacgtctgtttcatacagaatttgatcaaaagctgacaggaattgattatattcgttatttcactttaatgttcccatgcatctacatcctattaatcatcgcagagccgagcaaggtcagctaagctcaaagcagcaacatgccgattaccgcagagacggacaaatatactccgaaagccagcatagcagcgccagctggctgtatcttaccacccccagaagtgttggttgaagttccactaggtgcggtaactgtaacctgctgggtaattgtattctcgtgtgtctcggtaacggtttgcgtcgggcctgattcttcacccgacgctgtcgctgtttgtgtcctcgccgtagctgaattaaacaaaccagacctcctattagatgttgaggcccaaccccacagatcctcgtcacttgttgttctgctctgtgagacggctgagttggtacccgaatccccgttcttgcggcactgctggactgtctcccatccctcgtcaaacacattttcccaccagctcgatcgctcgctaagcgtataagtcatgaaaacataatgcgagccagggtaatcgtgcgccgtctccatgaacttgatcgagcatccggacgtgcaagggaagtcggagcgggcgtagtacggatcccgaccgtatccccagttgaaataacaccacccggtgctgtgacaggaatttagcatcgtgcataaatcatttgagacttggtatgaactcacctattcttcgagcatgaccaggcatactcatactggaagacctcgccgaccacttgaacaggaaccttcggcctagggtttgccgtggaactcaaaagggcaccgtcaccagacgccgtgcacgccttcttaacattttccacgtacgagtcaagcgaattcttgcatgtagttgagcacatgctctcgacatcggccacgtctgggttgaagttgggactgcccgatgagaccatgcctaggagggtctgatcgcagtcaatcgtggcgctgtaggcggccagacattctttcgaggtcgaagctgcaaggtgattgtgcacgtaataccagtaatctgtcaccacagtgtccaaattaaaggcggcgacggcaggccgcacggcgagcaggaggagaggagcgagggctaacatgtttgcatgttgatgaaggagtagggcctcggcacatcctggccatcaatttctggggataatcctagatgatataggaatgctcgatctgtagggctggctgcctaacgcatcagttcatcttggccccacgactgcggcgcagcaaatccttccccttgcatgtgagtggatagttaaacgccgaaccctgcttctttccacttgatgtggaagagggctaggggcactgacattgagccgagatgaacactctgccgcttgtgacagagacgatgccctctcttgacatattggactctgccgctcttaaaattgacatggatatgaagtcttatgatactgaatgacccttataatacggattctatgttggtaacatttcccaccgattcatctatactagatagaccctggggctaagagaaaatttctgtcggaagtcggcatttgtcagcaaattacggctaccggcaatggaggaaccttttcctcgtcatgtcactacctcttctaggtttagatatacttcaaacttgtcaagtaattaacgtaatgtccgaaaggccacgaaacggagatgaatcatcttcaaggatattcactgttagattgattacactgccccctctgcgttcagctgaaaaccgctgactagactgtgtgtaggcctgtactacttgtcgacggaagaaacttcgatgcgatggcgcttcaccccaatgtgcaagatgcttacggcaaggaattgaatgcgattatccaactcgccgaatgcgaggcccaaacaagatgtaggtccaatggaacaagaagcattatgattgttctggactgactgactgtcgcacacgatagatcgcaatatgtaaagggccttgaactgcaggtccaacggcttggaggggatatccgtgaatctagggcaacatcgtcggacaaagcacccacctcttcacgccctcggataggtaatacattccaactctcgtgaatgccgctctgccttaacaattcttgtttaggcagtgacaatacctcttcgcttcctttagaaacgggaggtaccggaacggttcagcaggctacttcttcgaaagttcccctccctttctttcaccaagcagagcgatcggtggctcagtcaatagcaggcatcaggcatggcaaactcaatatgcaagtatttgcggatgtcttttcgttcgatattaatgccgggctagtcaagtcatcctttgaggagattattgaagtatacccttttttcaccataccaaacccgcaggtgttgaaggtcctggagcaagaggtcagcacagtagcatcgaggaatttggccatcaccaactccttgctagccctcaccgttcaattcaaggtggcaaacgaacacataggcgaacttctccccattgcgtgggctcgattcaaaagctcgtatgcaaggctccctcaactcatcacccaaccgccttgcatctctacatgtcaagagcttttatatatggccatgttcttgcaagggtttgccgacgtacgaacctctcaccagctttcatctatagctgtcactgttattcgaacgattacctcgtcgagccaaaacatcttcaacttatccatagaggatatcctcatactatggggcgctttcagtcttcacgtggaaatatctcttcggtgtggcattgcgccctctattcgtgagattggcttccaagtgccgcctccaagtagagatgcgttggtcaactgcaccaacgaattcgcaccaaaaggttacgccgaccatgtagtagcccgagcagagctttctcttattcagtcaaacatagccgatcttgatacaaacattacgccaaatcacacatcgttggaaggcgacctcgactcatgggcaactaggactttcggtgacaccaacctagaatcagaggaatcactctcatatccgaccttaaatctcagattcgtgtactatcactcgagatttagattggcacgaatcagtcagcgctcccccgaggccggcataacatttgcccagtctacacttcggctactacggcatgttcccaaccaacagtatttaactgtctggtaagtgaaaattttatgttatagaaatcaatggtgctgaccattagaaggcgaatcctagtttatccaatctgggcatctcttgcgctcctcgaggatacactgcaaacaccggatagctcacgagcatgcacgaacagtcagctgcttcaaactttgtacaacttcttggaaagtacacaaagatcacagcattgcgatttaggatatatggtggaggggttgtcgaagatatctgctctggcaacggctgctttgcccggacagcaaatggagaacactcctacaacttccagtagtagcgatgaaaggccctggaaggtgagtaaattcgtgtgagaacccacttacaccaagtatacggcgttctgactagaatctgaagattcttcaatttcttagccagtacaaagatttcatgcccctggcgcagggcctcattggaaacatgctagagccatccattcgggaattctcaaacttacttggtatcgacgtccaatcagttgaagatttcggaccgttcgtccccgaaattctaaagccggagttatataattttgcattcaaatatattcattgaggccacggttggcatctgatgctcgatcagtactgattctaccagagcggtttaaattttcattaaagtcatcgagcatcgtaatttcctctctaattttacgttatgtactagataagatataagagaagtgattcaagcactcggcatcacttcttcaggttatcgccatgctaactctacatcaaaagctgtaggtactgttgaaaccccattcatactaagaatccgcaactactctactacagcagcgctatctactcgttcccaaatgcaacggattgcggatttggttgattatccatccgacgaggctggtggacgcaaatgggatggaatcgcaatttatgacaaatgcaatgcggatgggcttacttcattgtgagatcaataaacttgaaatatgaaatcaatatttcgatggatttactcatggggggattcaactagatatcagtggttcttgtactctggtacaaacagcctgtccacatttgacgatcaatcgaaacagtctgaggcccgttcataattccgtcgcctgaactgcggcggccaccttggcctcaagttcatcagaagttagaagtggcaagccgagaagttcattatcaatttccgggtatgcagcctcatgcttccctccaaggacagctgcctggagaacagggaatagtgctgtgggatcggttgggttcttggcagcatttttaatcgctttgtcaaactcaacctgtgcgtcaagagctatttccttccattccgttcctgttggcgagtgtttctttgcaaagcgaagcaggttggcctgtgtggtcgtggtgtcgttgatgtaaagaacgcggtttttcgtggcctcgctccccttgagaacggaaacaacagccttggaaatagtttcaatgcttgaagtactgaatgggtgcttcccctcatcatagaggttaacggaatggccctttagatcaatgaccaggggtgagttcaatacgtattccagaaacattccaggagagatgatggaatattcaatctctccctttgctgctttctctctcaagagatcttggatctcgttaagagggacatttaaaggcaggtctctggtaaccggcctcgtggtaagggcaccaaagtcggatggaatgaatcgcttcacccccgccctgatgcacgcttcgatgatgttggtttgcacaaggagtgcaggcatggccagagcggcaattgcaacatcttgcccctggagtgccttagtcaagccgtcaacagaagaataatccacaacgccggcaacaactccctcggggtactccttagtagaggcgcttcggctcagaacagtcacattgaagccgcttttagacagttgtgggatcagggcactggccagtaacccagtctagaggagttagtttagtatctaaggcaattaaacatgaaatataacatacgccaaagatagccacgttcttgaaggtgctcatattatccgttgaatgacgatgtgttgttgaagagttgttggtcgaagctgaaggctgtttagttggagaactcattcaatcgtacggatcaggtccgacctctttttataagatacgggagacttgagctttaggttcaagcatccagacctgcttgcaaatcagtccgcgacagagtttggtttgtcagtctcggatacaaattgcatccgaagtgggccacttcgctttgtcatttgctcggatgtaatctgccacgccgtaaaactggatcctcaacgacttgatgatgactgtaatgctaagaataggtctccagagcttggagtatgactacagaatgtaagagtacgcgagactgcatggcaaatcaatgcattgctacggaatggaaggcaaaatccacaacgcacccggactcatttctggatctcaaaggcaagccggcaatcatcatcaccggcaactctagcctgggattacactacggcgtccagggtagcctcggcagactcacaaggctctctgccaagaagcaaacagacgcgacgatttacatgctattagcgcgtagcaagaagggtgattagctcaaaatgcttgatttatgcccctcatcagcctaggacagagctgcgccaggtcaactcaaccaccattcctagttaacctagttgttcatggagtaattcaggtttcctacccgccaaatcaagctaatgcacagtcttttatccccgttcagccgtcttctatggaaagtgattcttatttccatggttagccgcctctagctttatgttggttgtcaagtcacgggcttaggtctctcccacatatgagaggagaaagagcgcacccttagacaacatatcaattaataacggattcgactgtaaaaacaaatcataattggaaagttcaagggtcaaaaggtttaattgttcttatcaatgacctgagggatagaaagcacggcagaagagcagaatcatgcagacggactggccagattgcccgccagcggagagccaatcagtacgatgaaggcgtggaattgcgagtttctccttgtgagtctcggggctggttattcaatcacacactggtaattatatactaagaaaagaaggcggtggcttgatattggttatttctacctcaattgctaaagccgggtcttgttctcaaccatccttgacatgtcattgactgccatcagcatcagatgttaaaagaaacgaaataaactatataataccgtctaatgtatcacccagataatctttccttgtaggctctcaaagtaggcagtatcccgtcacccaatccttacagtcatgccaatgctcttccagtttgtaacaccagcaagatgacaggtgcaatgcaaatcaactgaaaaggtaaaagcttctaaaaagcttcacaacatcagtgactcgaatttctataaagagggaagcccgcgccaagacaacagacaaattctttacttccaccaccacctccttcagaataagacaagaaatttctcattctcagcagtgccgtcgcttctctatcccaaatttcctaaatctgtcgacatattcttgccttatcttcttattcggtgagttttctgccgtctagtagctacgtaggttggttcttatgatctacaaccaaacatgccatagtcactgcccgctgtagattgtatattcacaccatcaccgattcggtaatcgtcgatatgtgcgacgtctattgggaccagtgccccaactgcgacgagatcttttggcgcgggaagcgaacatgtggaattgttggttgccaagaggagtataggcagactatcaccatggaccacccttgctgcatgtaggccaagaagcctgtcattaacgatatttcttgcaaccgacatgcctctagtcagcaatgattagacctcaccttcatctagtctcctaacgaacagataagccaccattaggcgtactcggtgaggtgcccgaggcatcagacggatgaattgcataagatggagagaagtggtcgttcttgatttttctgtctgtcctctagttattctgtatattaggagctaggacaattattagatttttttttgacagaaccatgtttccccgtgccaacagaaatgctctttgttcttcagtggggttctctctagctttccggtgcacgaccatcgaaaataaactcctccagctcccgaaacgccttgtcgagatcttcgttgaggataatcttgtcgtgtacgcctgtttcagcgtattctagctcgtctcgggctcgctcgagtctactctgaacactggtttcatcctctgtgccacggcctctgagccttgattcaagcacagcgaaacttggtggcttgatgaacacgaatcgcggattgatagtcgattctgaattcagctgctctttcttcagctgcttgacaccctccatttcaacatcgagcacgataattgagccttttgatgactggtcgatgatggtttgtttgctcgtgccgtacaggtttccgttgaattcagtgaactcgacaaaggtatccttaaggatgagagactcaaaatgctctcgtgaaacgtaataatatgtgactccgtcaacttcaccaggacgagcttttcgagttgtatgcgatactgtggcagcaaatgtccctgggtaggtattcaacaacctactgcaaagggtactttttccagcacctgacggcccggaaatgacaacgggccggcgctgaggcatgcttgctgctgaataaaggccagccaattgtaccaagttgtagtgtgtcaaaatgaagccaggctgtttaatcagcacaaagttcagttgaatttgtttacgctttgatgctaaagaggggaccattttggctgaacaaacattggtatcagcacgtgataggtacgacataacctgctgtactctgggtgacacacatgatgttggccgtcagttctgatgaagaaatttcagaggtaagggtaacatattctataatcaagagaagttaatatctctatataaataagtgttggttttttaactgaagttatatccttatagtaaaaactatcttaaagttatttataactaattttattaatatgattataaatatttattcgaggtttcttatataaaggagaatcaaataaacattaacactgaaataattaatcttaatttttgaaatagcttcaaattccgatcataaccttaactttataaaactgtatagtcatatttaaagcgctataagtaaagatataagcctcgaaagttacaagcggctccaagtccaggggtagcctacctcccccagcgctgtgcttgtgcttccaaccatcgagttcagaaaggtttctgagtgagaggtaataggggtccggcttccaccctggcaatctcccgtctttacaagcccaaaggtcagaccaatctttgccgaggttaccttcgagcatgtccgccacgtatctcccaatgacgggtaagaacttgaagctgtggttcgacccaatggtggcgatgtagaggcacgccgtcttggggtagggacaaactcggaaatttaggcctttcgccgcaccacccctgcatcgtagttagatagggttgtttaccgagttggtaggaagggggcgttgtaactgaccagcatagttttgttgaaatgaaggggcggttaacgagctcaggcactgtgtcccgaacaaaggatctcacttcgtcctcgatctctccggggcagccatcaaaagggtagtatccagtcgattgaagaatagaggcaccgggaagaatcttgttcttgtagtttgtgatcgcacgcggaaagatgatgcctgaagtctttttaacgatagtcttctcgtccgaagggctgtggtaccttgctcaaggttggatatgacgggaatatatctaactattaattaatctattagaggcaaattatattaaaaactcgctcacccggtatatcatccagaagcggaatccataaaaatgagttcaaaatatattgtacatctttccatttcttgacgccacatctgatggtatatttatgcaagcctctgttcgcccattccccacgcgctgggtcgctgacggacaatgccccaatcatgtaaacccagatcatgacaggaggggagagatccaggtcatccacatgtctctgatatttggtggtgaacggcttattaggaagcctaatatctagccactgtatgaagacatgatgagtaaacgctagcaaggcaagtctcaccgattcatccagtgagttggatggaaatctgaacgtgagtagtcgatacattgtcgaggtcatggtttgatgaataatctcgattttcatcaactgctgtgtttgggacgcgagattcaccagcatacagaatctcttcagaaccttccaaactgtcaatagatcctggtccaggttctcgaataactgggcatgccccatggagtattgaccctcatccggcgaaactagtagttccactgggtaggaattcaaattatccgatgggtattggaaaaagactggatttgagtcgttcagtaatgcgattcctagatcgcatctatagcatgttagttcattattaggataagggtgtatgttatctctctccggtacctcataatctctacgcacaaatgggagtgtttcaaggactttagacctcctctcaagtcaaccattctccgaatgccttccacatgctgtttggaggccgtagaatctccactaaaatgtgcagcgcttgccaatttcgtaactgctgcaatagttgaatcagtaactttggccttctcgtcgtcacccataagccggtagcgaaggagtctgatgcctttttgaaaatgcagtatggccatgggactactcccagcgccgagtcttaggactctatggataaagtcatccatgagtgctgcggttaaatgcaggccagcatcgtcgccttgcaccaatgccaacctgctggctgggtctgctccgtgcgctatagcagccacaagaggatgaatgactttcattgccgtcgccgagactatgcggttcaaattaagcaaggcttcatggagagcaaagatttgtgtttcacgaacctttggcggtgttaagaagcatctctaatttaatatcgtcggcaaattggaggaatgagagatctccgcccactcggtaaggtatttgctcagtacgtgtgatattgttgtcgaaaatgatttggaaaggcctcttatgcatgttttctatctcaaaacggctggtttgattcgattgcttcacttggattgcatttcttctccccttcgtgccttgcctcgcatggctcctaatagtctttctagcggcgggatccaccttgccggtgctagatgagaggataaagggcagacttgttgccgtagagtggatggccttggtttggcgtgaaagctccatgttctcttgtcttggcatacctatgcttccttcctctttcttatcctcaagggatggaaacgaatagggggtggtatcacctagtatgagagccgggataatgccgcgtcgtcatggactgaaagagaatgccaagctatattggttactgcattcgggatggctataaggaagacctagagtgtctgtgtctggctttcctctcttctgaagagtggaggaaggagagagagggtgaattcttctggccggacaactttcccagtatgaagcgctggccattgcggtttgggattacctcatcgccgtgccatggacggaaagggcatgccaagccatgttaactactatgtctggcttagcaataagcgctagaccaggatcttgtcgactgactcgggcttcgaatcccgatcgaagacgtgcgccggagttgaggcaggcagcaaaccgcgaacatatataagacgctccagtgttcactgcagagaagaaatgtcccgaggaattcagcaataacttccatcttgcattttccgcttgaaccatgtcaaaccccaaaaattccgtgctcattaccggctgctccgctggaggcattggtgccgctctagcccaagtcttccaggaaaagggttacgacgtgtttgcaacagctcgcacgccatccaagatctcgcgtgaactctcgactgcctccaatgtcaccattctcactcttgacgtggtttcgtccaagtcaatcactgccgcagttgagagtgtcagaaaggtgacgggtggcaagcttgatattctgatcaacaacagcggcatgccgtttcgggcaccaggcctagacgtgcccatagaggaagggaagaagctctttgatctcaacttttgggcacccctcgagatgcttcaagcattcgcccccttgcttatcgaagcaaaaggatgcgtcgtcaataactcatcctgcagcgccgttctccccatgggtctttgtagtaagttttacaatcaataagcttggtgacaccctaggggcatcttactgacttgatccaaggcatttatggcgcatccaaggcggcactcactctagccagcgagacttggcgcctcgagcttgaacccctgggtgtccgcacaattacaatctccacgtgtgccactaagtccaatgcccagacaaacggattcaaggccaaaattccagaaacttcgccatactattcgattcgcgacttcattgagaagccctccgacatgcaggcaaaggcaatcacagcgagagagtacgcaatcaaagtcgttcgagaagtggaggccggtactgccggcatcatctgggttggaactaattccttgatggccagactggtagcgtctatgccggggtctatcctggtaagccattctgaagagccattttcactctgatcagcagttttgcgctaactaatttgaccaggacagtgtagtggaaagtgtaattcctgttcaaaaggagatggcaaaagcgatctcagagaaaaactctagctagtacattgtagagtagccatctcatctgatcaaatgtcttcagggattatcatttatatactccctcttcgttctttttctatatttcttaattttgaatttcatgcctcaatcccccctaatctaacggaggtggtcagaaaccctgctggatgaaggcacagccaataatcttagactaccatataccgtcgctcttcaacacgtctgtctctgcgattagttacatgagctcgccgacacagatttaggatcgaggtctgttattttcttatagtgagaaaatcaggaacttaacagtccgtgatctatgaacagagattccctgtcaggataaccaaacagtacaagactaaagaacttgaagagactggctatgaactgctcatggcgttgcaagcattgtgtcttattttccatttcatagtatccaatggatttgtaagcggttgctatctttctctactgaattgagagccactacaacaaaacacgatttgtatataatcacgtatgtcgtttgccttagtacttattcatgagagtagcagttccagtgccttaatacctgaagacaagtaaatcctaaatgtggaaattttcttttgacagaagaaaattgtatcagcttactgcataattgattttgtgttaaagtggaggtgggtaatcttttatatagtgctacactgattttaggctcacacagccactctcttctagccccatcgtcatctgctcaatgagtcaactcttcttcctcaagtgctcgcggcctgcacaagcttctctcaactcataaatgaccaaaatctatcaaaatctatcaaaatgacggcatatgcagtgctacctctggaactctggcactcgatcctctcgtacctttcgctacccgacttggaggcagcgaaccttgcctctcactactttcatgcagtcgcccagaactgcctagaaaaagagcgcatatcctatcgtcaggcttctgaattcagagcagatgattacgtccaggatgaagcgataccctggcttcaaccactgctgagagtgcttcgcgacccgttcttcgcgacccgttcttcgcatcttacgttggagagctcgatacacagattgaacaaagtggctttgacctaaaccgctttttggaaatctataaagaaaagaccaaagatggcatcgtgtctgttaccgagatgtcgctcatcagacaagcagcacggacgacctttttcgactggttcgatattctagagcacccagaataccaacacgagtttttcgatgatgtcgagaggcttgaacagtcggccctcttggctattctcatgtgccatctccccaaccttcgggtcctcacactcaccgctgcatgctggggcggcattgaagaggcaccatggctgatgaggcttgcggaccaggttcatcgtcgcccagacacaccactccatggcggccgaccttttgctcgtctgcaacacctcaagggagacgtgttcaactgctactacgggctagatctggattcgatcaccccattcatctcacttcccaccctcagatgtctcgagacgccacagaatcacgacgacgggttcgactggccagaacatcttccgcgatccaacatccgtgagatccccctcgacgaaagcactatacccgaagaagcgattagaacatttgccgcgcaggctctccaggggccgtgtgtcatacagcaatcagttggatggagaagacacttcgacacgccggagattacatggagcagactggaaattcctttcaagggtgccaaggcagatgaacatattgtggaatggctggatgacattgcatatccataggagaagggtccataggagaagtggtgggaggttccgggggctgaataattgcatcctatttccctcattcttcttcggagcccacaatgagtttgtgagtactgataatttagcacaccagagtaggaatgatagcttactaggctttctagcataacaggtcaataacctacagtgccttgctcttattcccccatagaatcccaaaacactattcacatattagttactatcctaatatctaagaaatagttaaatgtgaagttcatcttgtgcgttatattttcaatctgctccctgtttgcattgttagtaagatgatactaataagagttggttcgatattgatttatggccctagtctacagatccgctcaattacggtgcccgatgatgctatttagggttcgaggagcggatggcttatatgacaagagagagatatgaacccgtcgccatcaggtatcaagtcgagttcttgcttgtcaagatgtcagtggtcaagatgtcagtatttccctcagccatagatgagactttttacagttgtttcatcgcgtttcatctgatgagagaatagttcccactctgttgaccgcatctcgatgtcacagagtacggaggatccagtcggccagttccccgcccgggtgacctcggcctattgttttccacggaatcacctctgggcgtagcattttcttcctggctaaattagtcaaatgctccccatcaccagcacacattctataaagaaacagacaaaggacattatccagagccgagtaggcccgaatagactattcatgaacttatgggaatcagcggggcttctagctataagagagttggtctatatatccacttcgcccaatgtgacaccaaagccggcaatgcaacgccaaaactgaacgacgatccgactcgacggtcctcgacgttcctaaactggggaagtcatttgctccaccgtccgggatgatttgtgtgacttggcgtatgtcatgagacacgcctgcacggttaaatcaacattgtggagatgttaaaacatggcaggtatataagaagagagttatatcgcacgataaataccatctctcgaagattggaccgtccttactaccatcgagcccagaaactttactttcttcaccatggttcctcgtgttgccagctccattcttctcttcaccctgttgactctgggacaggagtgttgagtcggggcccacttgtcaattcggccaggttagataaattagctatttttttctgtatccgtaggaaatgaacatgctttataccccttcttattttcgcttttgaaaatcccttcttatgaaagatacgtctttcgcaacctcacagcggctacgatcggtcaattgactagctgtaaacgtgaaccatttgatcaaatgagaatacacacaaaactcaaaacctccttttcatagctgttgtggaaggttattagattttggtgtggttagcagtctgtatttcaagctcgctaacagctgcggtgttgttcgtttatccccaactcaaatggaggtctcagtggggagatacataactgaactctgagtaacttaagcgctcctcgacctgcggatcgaagcaattgagcaaaaagagaacagatataataccttctggctgtcgtaagaaccctctcctagtaagggattcatacacaagagccttccgagcaagagctgcgagatgggaagaacgcaaggactgtgggcatgcgtttgaccctgactgctgactaacgtattagttaaagacctcggccaagactcggacttctctctctagcctcaagaggctactgagaagcctagtattaataaaggctgatcatctctaaactaatctggtcccgaagagccgaaggatttattatataagttattcgcttaaaaggaaattagacaaaggggcagagttattactaccctatccctcccattagcttagttaagggataaggaaggaagggaaattaggttaagattcctggaagagaggttgatatagacgaacacggcgctgtcctttggatacaagcgacctctcttttcaccactcatcctgctattatcccagcttccataacagaatcaccgcaagaaccacttcaaccatttgatcagacactttcaataatgcctgaaaatcctgaaagcgatccggctggtagtagctatcgagataagtcacccgggaaggaactcgtatcggcgttaacgcaagccgttgagaaaatcaaccccttcgcctacacgcttgcaatggaccgacggttcgatggctataacgtaacctcgttccttaagcaatacaacaatgtaatagactcgagaggttcatcaaagaagtatcgcctcaaccagttggagtttaatatctctaataacaagtagccaagggttaagtgttatattaaggacatagaccgctaggacgaagttaaagctactctcaagaaagaataccggtaccttgattgcgactaaaatatctctccattgaaagaggttgaacgaatcaataagataaaactaggagataacctctataagatcaaagatatcctgatcgaatatcgctacttctggaagaaagaccaagggcctgattgggagttatccacgagctaatcagagaacctctgcaagttgatacctctagagatattctataagattcaagacaggcagaactttactatgaaggagctctattcctaaccgtataaggtactgtaggagatatttatagtatttattagagaccggatcaaaacctctgaagaccgcagacgagtcgataatgaagatgccctatacgagaccagatagcgagagcaatatacgaccaagttgcgagaccccttgattaaacagactgaggttacgaaacaagtgcggatcttggatctatcctctcgtcaggagcgggccccgacagtctctcgggtcagttaggaaaaggcctctgaggtctctataaatgacctgatagcgtaaataaacaacttggcggtctctgtacagtagataagtaagaggattaaaatcctaaccccttcctctttaaagataatagaagttttactgcgaacccaaatcctgataaagaggaaccctcgaggcagctatacgaattcaattgagatacgagataagtcaattaataacagaggatttgattaaatagatccaatagaaattaacgctctgatggcatacaattacgacagggcgtgctggtattacagaggcccagactactatcccgattaatatatagaccttaaagccgacgaagagactgggtttatctgttataaacacttggctggtaccttatatctagggaacaagagagaagaagttcctcctgccttagtcaattactacaagcaaatgttaagtgtacgaaggctcgctgttcactatataagacagttcccttattataaccccgacttagcctagtgtatgaagaaggtatataactctaatctgacaaggtgggtaatcaccccgaaggaagaagaggttatagaccgagttatacagagaattagaaaccgttgggctcttaagattcccgctcctgagaataacaaatatcttcccacccatataacagccacaacaagggaaggtggattcaagaggcctggtacaataactacatcttatatcagcctggtcgacccaagcatcagagcgagccataataggtcagaaccatttgatcaaataggttacatttacgcagtcaaaatgaattcagccaatctgaagcgtggaaggcgggatgaagagggctcctcatatattacacaacacgaacctgagggtatatcgataaggtataaagacccaacagatcacagccctctataagcgcctgaagcagctgccgacttatgtagagaagtcacagagtaggaacttgctagaaaacagctggttgcgaaggctattaagaacagcaagattactatcaagatctccaaaatcgcctaacttaaccctacctttggggaactccttacagaagaatactttagtcaagcatacgggcctgaacaagtggttaagaacactctgttgagcaataacacccagttgtatcaacctaggagatataatactagagctaatacggttgaaatccgagatcccgagggttccggataaatcgtgggcgaggttatatcggcctaagggttatataatgaaatttgcagacgcacgatcggaaataatacagggaattattctttaaagagcaataagaataccgcttatcagcctataactctataaccacacgagttagactatagctaataccttaaagtatttaattaagtggattctaataagatagaatataatttgattaatatacgggaggaggtacagacttagggtcgatctattatggatttataagaaactgtaataggtaataggatatcagttaattatatacttatagaccacctggaggaacgaatagttaaaggttgttaagacctcccttatacacctattcagctataacgagcagatagtcgagtttgtaatactttagttaacacaggagcacaagcgaatattatagcccttaagatagcccaagagtacaacttagtagtctatccaatacctaatacaaccacaacttccttctcaaactatataatagagataatagagaggatatatataaaggtgttcctcggaagtgttccctcagagcaaattatctatataactaaaggcagggatatatcttccattaagttcatcttaggaatacccttcatcagattataccaggtttcctttgactataggaatagaggcagtaacctacttatataagctgttatcagtagcacccgaataataactgctgtcgcaggaggagtttactataggaaccctaatacgcctaaagctattacggctccctatacggataagcaattgagtgtatatcctgtattaataaacaaagcacaacctcaagagatagaggagccctataacccgtttatttatatcagtaaccaaattatacaggattatatagactatacctgtataacgataattacagctcctgatgcaggagagcaattcagtatgaatccagtattactggaggaactagaaccctaaggggtagaaaaacttaataaactatttgattaagtagattctagctccagggaaccattataaatattttatatctccttggaagatacagacagaatcgtaagtatggaaattaaggagggagacattgttatccctatctctgataataaggctgaagttatcctccggaaaatcttaaagactcagttacctgcttacgacaagcaatacaagcaggctactgagtaaagcaattcttataagaacgaaataagatactttgaaaaataccttagcagaggtgctaatatactgaatatcagtataaatacaatatacaaactaaagcataagaaaatcaaccccctagataatattccatccgacggttcagtgcctgacggtaatactaattggcgagagaagaaataggctaaggctctattaactctcgatatattatacctttttcctatatagattactagcaagttctccgatattaagacaggctccaggcttataaaggagcgattagatactattttattataagtaaaggacttcttaacagaaaaagagctggaagtatttattcaaatactttataactgagaaaaagcaatagcatagacttttaaggattatagccacatcgacctaatagtagccccgcctcaagtcatccgagttgtcgagcacaaggtatagcaagccggatcaattcctatcccgaaaggcttggaaagcaaggtgatagacatcctgagagactgtattaagaaaggggtacttaaagagtcttatacttcctacaggaacccttagttccttatagtcaagaaagatagaggcgtgagattcattaactcagcaaccaggatcaactaatttacaatcagggatacccttattccccctagcacggataacttctcgcagagctttacgatatataagatcctattacttattaacttcttctcgggttataaccaagtgtctcttaacccgataagcagggacttaactacattctcaatacctattgggctgtacaggatatatacactccctcaaggagcaacgaattcagtagcctaatttatacggattatcagtcgaattctcatagaccttatccccgatattaccgaaccctttctcgatgatattactatacgagggccttcttcaacatacaataaagaggaggtagccccgggcattcgatgttatatcttagaacacttgaccaacctgaacaaagtactggtcaacattaaactcgcaggttacacaatatcagccgttaagtcaaagttctactaagcgggtacagttatagtagaatacttctgtagctcatttagaaggcgacctgaagatataaaagttattaagataaaggaatagacagcttattgcgatatatctgatatacgatccttcctgggagctactaggttctacaggatatagatagaaaagtacgctattaaagctcaacctcttactatcttacttcgaaaggacgctgtctgggtctggggagaagaccagataaatacaatagaagctctcaaggagaacttaattaaggcggacttccttatctcaattaactattcagacaagggcggagagattattcttatagtcgatataagccttaaaggctggggagctgttcttctccaagttatcggaggaaagcgaaggccagcccgatataaatctggttgctggaacaaagctgaagcggcttataacgcaactaagagagaatactgaggcatcctcttggccgtcagaaggctgtgtaactacctctatagagccagatttatattagaaactgatacctaagtcttagtgtcgcagctcaacagaagggctagtaacgttccgggtgtacttattatatactggatcagttatattatactatttaattttaccgtctgctatatacctggaaagagaaacagtatagctaacggactttctcacaagggtcaagaactatctgatcaaatggataaagtaaacgaggaagatattaagcaagttattaacttacaattgaacgttgtaacggtttcaggagaggaggctaaaaacccacttaaggggtattagactaaggaaagttaaaccctcgccaaataccttactaccctaaagcagccagagagaataaagactgctgagttcagaaggctaaggctccaagcgaagtatttctttataaccaaccgcaggctgtggaaaaggcctgagagaggacagactgaccctattgctattattaataaacctgctactaggaaagctctggttacttcctattatatagagcagggtcacagaggaagagagataacctacaagtggttaaaaatataatacttctggccagggatatagaataattattctaaggctatcgcggtctgtaagatatatgcttcttttgacctaagacgactagcagagaaaagcgtgctaactgcgccgaattagcctataatgaaagtttactttaacacaacctatataaaccccttaagagggatgaaatttattatagaaggccggtgtaatctaactggttgggttgaagtctatataacgaagaagtgtaacacagctaacctccgcctcttcttccagaaatagacgtacagattcagcataatagttattatcgtgctggacgggggagctgaaggcaaaggagagataaaagtagctctttctgatacagggatcaggcgtattattatcagcgcgtacaactctagagccaatagagttgttgaagccggacactggttattgatcctggctatcagcaagatgctgttcctaaacgtcgactagctttaagtgcttaaagctgtgctgttcgcggatagagtttcggagagagcctcttataggtatagcccgttttatctgttatatagctggaacctgatcctgcctctcgagataagatatccgatatagagacttattaactgggaagatatacagtctattcagagcctgctagaggctaggactcgatatctgctgcaactctataaggatatcgaggtcgcaagagagaaggttctgaagtttaggaaacaataagccgatataagaatagcaaccttaattagaagaataaggactgagcctctttaatcggggagcttagttctggtctataatatagtgtacaataagatccgcaaagatacagcccgtaagctgctactaagatagctcggcccatacaggatagtcgatcgaagcggatattcgaggtcttatagattagagacaatagacggaactgcggtccgtagcaccttcgcaccagactgtttaaaagagttccaataagatgataagggttggtggagaagcgaggataactcctacttagtggaggaggagctagaagagaataatacagatactctcgcgagctactaaattcctaaccaacttgggcctgataaagagaaacttttagcagataataataaaccatttgattaaatagtttataaacctgaagatgataataagccccaaatggtgataaggtcgcagaaaagggttatattaatatagcccgctagtcctgacagaagcgatagatctccaaccttggataagatcgtcgtccagatgggttaagagagtcggcctatttcgtatataataaagcctaggttctcgccttctcttcacgaggttaataagaaggctcgggggagctaggagataactttatcttatacgtacgatacaccaaagatcacatatacaacactgagaaagccagccgaggcaaaataaaacagtataaagaagcggtaaaataaaaatcttaatatctgctattgcgaaacgacttgattaaatagttccaaccgtaatagattaatttaattaaaatcccgtaataaaaagcctgataatcaacctaaaaccgtagaaagcccgtccgggctaagattaccctacacctataactaaggaattatatctccgtattaacctaagtgctgaaccaagcaatatcctcctcagttagcgggttattactagtaggctcggggggccaatatcgacagagacggggggctatctcaggggaaagaacctctttagtacggataggagattcaactgtattataactgtaaagagggttagtaacaggacctttacaagggttcttaggcttatagtcgaggaagtaatacttgcaattactatatatataatagagataattagcgtaagaaccttgaaagtggtttccaagagatatatatttgaagaaagggaatataatatagtacccagactgagaataagtagttaagaaagacatgatatagtaataataagcgatcggattccattgcctataaagagcgataagcaaagccttggagtgaggcttcttccggataagattagtaagaaatatagatcgcaggtagccaagttcagccgggaagtagactggacgaggtaataaataagccctgatagcagtactaatagcggcatcattataacaagagctgactatcttctagaaggctttgcaagctcgtttctaatcgcctttgttatccttagtataagcaagttcgcagtataagggatcagcgcggtaatcgagagcgagctcgctatagaaccacactgtaagagtcttttggagaatatccgcgaagtcgagcttgttgtattccttggtaggaataatcgcagcacgttgattccagcttaaactgtggataggcttaagctctccgatgtggaaaggaactactgctgtattatagatatcggggagtttattgtgcttgatatcctggaaacggtctatagtgtaactggattaatctaataagctagaataagaaaagaaggaggcttttccaactagatataaggcccttatggatgaagaattccgagagggtgtataaaggaggagtgttcaagagcgaagggataagggttatacagaagcccgtaataataacgcgagttttgtattaaaacgcgtaagtttactgatacctagggtaaacccgccctttttcctactatatgtttttcctcctctttaataccgtactattatttataaagaaaaaactcactgtaactatttgaacaaacacttcccagcctaagatggtcgccctgactctctttgcaataggagggtctgaggaaaccccgccctctaactcagacagccttatcgaagagaataaagatatattcagaggagattcagtaaaataactctatatacaatattaacgaggagcctgtcgataaccacccttcttttcacagcgaactgagtagcccgtcgagcagctaataaataaacccctgtccgagcgagaccccaaagacggagagataaccctcgcggaataagaccaagatatcagtactattaaccctatacccgcttaaaagaacaataactagcaattatcgccttccgttagggttagtgaacgtcagtatctacaggacgtcagataggtactacttaatataaataagcgcagatagttattaagcgaaggaatccaggtattacagacaataataacttatagtctcagacgttttatagccagactccccaacaagttgatcatcgaccaggtcggggatctggataactccttttataagctcggtgagtaatcagggaggtttatctctggatctacagtagtaaggggtaacttcactggaggatttcagtcttcagaggaatattagtacgaagttggaaacaggaactttcttattagtactattaacttcggggatatcaaccaaggaggagggatatactgggcgatatttatcctcaacagacaaatattagttatctattattataatacccttgttaaaggcagataaaaacattttgctgcttttgttatagccttccgtatattcttaacgaactggggtcagctgtataacttcctcggagtttgctgccctatccccgaccaaaagaatagctgggtatatagccttcttttaaccttttgtatctagcaggtcattcggagcttctgcgggctcaaaccgataaagctctttgaaaactgtatactgctttaaagaggggtatatccctaaggctacctaattatactaatagttcaactgtatattagaacttgggactattaggtaaatgctgctgaatccttagcaaatatatccttacttatgataggggtttgtataaataaactaggctgtgttaatacgaaagtaactactaacggagtcactaagtggataagagaaggaaggcatatagctgtacaagcctttgcagctcctggctttagtatacagcaacctgtttaggaagcctgtactaaccttggaggaatacttcctattaatatcaaagagctacattagaagtcaaaggaatagagaacctgctatatatacctagaagcgagggccttccagctgctattacccttacctatcccggaaggcaagaagtatacccccgctcccagaatccctatatacaatatcttcttggaggatacaacaatcgaaacctttatagctgtaattcgataacccggtcctcacttacgagctgatattatctaaaaatagaggaatcgcggagaatttaatagttcagtaacagccaaggggagctaaggcgaaactgtgcctatctccgaggttaacctctgcttccaacctcaagattacagagtaattaaaatccctggaacccctgttccagaagatcccggagcttctgactttaagcaatgattaacaggaagacttggaggctgcgagcgaagcttgagtatttatagctcacccaaccttacgcccggaagcccgataagagttaatacgcctcctcctctgcctcctggatcttcaccctcaacaagaggtataccgcctccgccgttaactcctctagcaactcggtatccttctgtatctaccccaggaatacctcgtacgttcagcagatttactatcgctatagatattacaagagaggatataccccttagaaccgatctacctccccttaggggaactgggaccagaaacactcttattaatatcaagcagcagataactggaggctgatagaagcaatctaacgagtctcttatcgataacccgttacgagagtataaagataaccccgcttaagctcttattatccaggaattccgaaagtttatataaaaggctagactcccttaccctaccagcaaacctgtacttattaccccttatataaacaaccaccagactttatatatgtatataactgtagctcctacaggccttataagccctacagcctgggataatatcagtacggccctcttcgaaagcgccgccccagagaagagctcgttgaagttattacgagctgagcgatacacccgatacaacgcgcgaccttaaagataggagcggagaagggagattagcccttagaatttccacgagatttttcaagaagataagaagagcaggaactatttgatcgaacggttctgcacgcaatacgagaatattggggtttgaattccatcagggaattatctacacagggtagtacagttacacagatatcgaagtaaggagataagaacgaatggttttggcgggaagacgataagaaaggtatagttagcacaactaattgagcttgtaagctcctaatcatttcctttgttatatgagagataataggaggcagggcgcagataattgaaattgaatttacaaaggggtggaattagtaatatatgattttaagtgaatgttgatatgatgtccttgagcgaagggagggtaacccctctgagtgctaatacagcaagaactcgccggctattcaattcgaaatcatatacaaccatttgatcaaatagatctctacacgaaaataagattaggaagttatctggaagcctggagcagccccgaaatttggatataatggagatacgaggacacatgcattacatccggggagctataagtcggggcccacttgttaattcggccaggttagataaattagctatttttttctgtatccgtaggaaatgaatatgctttataccccttcttattttcgcttttgaaaatcccttcttatgaaagatacatctttcgcaacctcacagcgactacaatcggtcaattaactagctgtaaacgtgaaccatttgatcaaatgagaatacacacaaaactcaaaacctccttttcatagctgttgtggaaggttgttagattttggtgtggttggcagtctgcatttcaagctcgctaacagctgcggtgttgttcgtttatccccaactcagtgtcctcctaatcctggcacagatcccaacgagccatcgttcggaactccggtcccaatccgcccagaagacatcccaagtggatgttctgatttcgagattctcgctggtgagtattgagtggttgccacggagcgcctttgttcgatgccagaaatgttatactgaattatattaagctcgcggaacttccgagattggcaagtttggttatcgtatcggagaccctctcatcggaaacgtgactgaaacccttcaaggcagtcgagggtatccagttcaggttcgcacccatccttaagagctgcgcaaaagattcaagctgacgattagccaattaattgaagtacccggcaagctccgactttgccaatggagttgctcaaggcggtcttgacgttgtcaaccgaatcgaaagccagtcacagctttgccctggtcaaaccttctctttggtgggatactcccaaggagccatggtaatgcgcaacgcgatcggcaacctttcggaatcgctgttcgaaaaggtgaagtcaattgtcctatttggagatccagaaatcgactcggagatcccaacagagctggaggcgaagcttttagaaaactgcgcgacaggagacttcgtaaggacaaactccatctgacatgacgggtatagagccagatgctaattgatcacatcaggcatgcgacaagtctggaacgacatgcccctacggccatatcacatactccttccccgagtggatcgagccggctgaggattttattgtcaaggcattttcttcttgaattgagtcatcgtggagttggagttaagatacagccgttcatggacagtgctctggtaaactttcaagtgctgcgaggcccatcaacggagctgagaacaacatcttgacactgaaacaaatgagactctgttacacacctagctgtacatcgatcaaacagtgtgaatatcagttatttcatcaatccacccgtgagcctgttgtgtgttcaaccaagtcccaagaaattagttgatgactccatgttgtgtgatcaatgtccggcgcgttaagcgaacgccttgtagagtatgacgtgtgtggtgaggttatcaaatgtaatctctccgtgatgggatcgagaccttcttcaaaacaacgtagcaagggaatccactagcatcctgattctacaagactctttgagattaattgtgaagttctgcgtagctacatacagaagactagacctaaaagaattgttctttcagcagcatcctttactcctaaaggtaagatggacacagggtatagatcaagaccagaatacctctgaatcccaatcaaagggctgacagcaacaaggttccaaacatgaagactttttgtttgcctacgtcgtcgggcagacggagcattaacttggctattgtcggggagtgcacaccttaggaaccaattatctatatgactgttgatatgattagtactaaggatataagctccaaatcttgtagggaaggtttagttccgattagttctttgttcccaactgtcgaaactaaccctgataatcttgaaaagatgggcctttatgtttggggatggctcacgctcagtttccgttgtgctagcagttttgtaataggagtctgtctcagattactggcacgagatctttccacctcacctaggcgagtttgctctcgcctcaacacgattcgttttcaaagagaagataggtcggcgacaagctgctgctgattgatgtgcagtattagacctcgggaaaatgttgacagcatggatgtttacccgaatgacgagaacactgtagcctcggagtatgacacaagtatctggacggaattgcgtgatgtccgaagtcccttgcccacttagaactggacttcggaatctttccgcgcagccagtccacttaccctagacactttgaagccgctcaactacctgaggctctcggaggacatgcaatcgcgcaaccataagtttatatatccgtaaaggtattttgataattatgtcaagcgtttgggatgccggggtgcctaatgaacaatatcttagtgtgcaatatgattatagtgtccagttagtcgctctattacaggagcgtttacaaacccatgtctttggaaaaaacaaagaggagaagtaaatgagcataaggtgcgattaaaataacacaggagatcaaaactcttcgagatcagagagtaaatattcgagtcatggacaagatcaagcaataatctcccgttgtcatagcgccccgatgaaactaggtccgcgtgtactagatgatatcgtgaccgatggaacttccgattggattcaatctcgccgcaccagagtggttaggattgtagaggggcatgaatcaccgtaagtggggtggcagtaaatgaattagatagctcacgggtgattcaatcgttacttgtccggtgtatttggctatggtatacattgtgaccttacatctactgctcagagggctctgggagcgactcgacgagttcaatcactttgtgatcctccatagcggccgtataccgcgcacacatagcccacacacggtccttgcgctgcatctgatacggggtgaggatccatcccattccacacatggtagacttcttgtattccttcatcacctcctcatcctctactgagaggctcgggccgccagctttggccagagcctggagataatggctgaatagctcgacttcgtgagccctgcggtcctctacagacaaagcgccgatcatgaagtatgtaacatcgtggaaggcacagccgatatggttggtttgccagtcgaggaagtatggcttgcccgccttgtcaaggaaggtgttgccagagtgagggtctccatgcaggacggcaacatatttggggtttttggtagcgaaatgcttcttcatggcggcaactgtacgctcctggactctgatgctttctggaatgggtgggcggtcatcgccgagtaccatagcctcccagttcattgtgagaccaatcatgacatgttcgtatgcaggagtaagccatgagttctctccgctgacggtggaaccccaggtcccggcgtggagaccagcgagctgttcgaggccagatcggacacggtcaacggaccagtcatcgacagggtcgccaaaagtatgttccttgctgagatcctccataataacaatggcttgaccctgatctgggttctccccagcccaccacagtttggggagggagatattactcagctttggggcgacgaggttgaagaacttgacctcccgagagtacatcaacttcaaaatgtcgctgtagccttccaggtttagcatagctggattgaatccgcccttgaggcagacataggttggctttggtgtgctgttattctcatcttcgtaggtgatagtgacgaagatcttgctagctgtagcgtcgagaatgctattggtgatttcaatcgacttcaccttttgtttcaagacttttcccagccattcagcggtgatttcctcaggcaccataggcagcgcaagcacgcctctcgcaccattgacgccgttggtggcctcgacactgttcgtaccattgatgactgacatttttgcgcaagaattagaaatattgtgtataggatgaagccaattcgcaatcttgcagggtcgattgaacttccccccttataccatctttgtttaccccaagctcaggaggcacgacctcctacccaggtgagttaccatcgcttaggccacttgtacccatactagtccacgttatgccaatatgataagaagacagtatgatcgaatgtggatatgaaaacggttccacatgttcgtctcgtcaagggtgattagacagcaaacatgtctagctagctcaagggagagaatgcactaagatgattgaggaagacttactgcgaatggacagtgtcccatgggagaatggccgtgtcggaaagtcccccggttcagtctcttgaaacgctaagtactggaatcagcgcattctacttaggctatctacttagccgatcctactgtcctttggccaggggatgaagttatctcctcacggcaaatacaacacagaacgaggttaggtggtggagaaaccgttgagaatgtctccgctgatgcacggggagggttccgtctccatccatggagccacttttgtccgtcttttgtgctaactgagaggaacccgcgggcgagggcaatttcggaagttgctacgcctccgttagtgactgatgctggttgatcacccgtcttgaaggaatacgcgcgcgccagaaataagcgatgttgttaagtttcaggaaagctaaagcgtcgcaccttgaagtaaataggggtcgactgattcgaccaccaacatatactcttctcggaactgcacagcagagaacatttggaagtgctggcagtttcccccatacagtggtaacgttattggtattcattgagccagggtgccaacccaacacgccactggcaaggggtaggcccgatggtttggttctgctcctgcttgggagatgggtgaaacctccacagccttggaaactcagcgatgaaatcaggagatgggcactttctgcatgctttcgcttcatggggtggcgtatagcaactttccgctcccgggcccctgcattactgagggaatcgtgacgaggcagcccagccactagggttcggcttatctgagggttgatatagcctttatcctgggcctagcaagggaaacatccaggggatcaaccttgtatacggtatacggcacttcttagacacgcccctgattgtcgctggttataacctagccttctttcggctagatatatgaacagggcaatacatagtagtcggggtggctgtcggacgagtcgaccaaagaactctcaaggtcggcgttcacaggagtatgttgcatgaaacattatatcccggggagccatgggaaagggtgcagtttgtggaaaagagttgcatctgactaacctgacatggccactatgccagagaaccatcatctgttctgtctctgcccatttcgcgtgtctgaaaatgtttcccgttggccctgctcggtagttggacacatacaagaccttccaatgctccaactcctcaattgtcgttctgcagtattcgcgcaatcggtcctcagacgatcgtcaacactcgaaaaatgagtagtgtacgagatgcctactacccgatcggtatcaccttcatggtggtgaacgccgtcgccgttgggctgcggttttgggctcgagggatcaagagcgcggttggatatgacgataccgcaatggccgtctcttttgtaagatcatcgagcttgaccaaaagttggcttttactgagtactaatggacgaaggttggcttcgtgatctttgttgcgtttgagcttgtcgcgatcgacaatggtattggcgcaaccgctatggaatccagctttgacttaatcaaagcagcaaaggtcagtcccccctgatatctttcatcaatgttgagggtcgcgggctaatgttgttattgcttggcgcatagttttttaccatcgcccaaatcgtttacattctcacgactggcatatcgaaactcggcgttgctcttgtgctctatcgactctcagacagatccgatctgaaacacatccgactggtactaataatctcgatggttatcgtcactctttggtgtttcgcaactgccctcttgtacgcgctccaatgccgcccgctatcggtggcttggggtgtaggagaggggacttgtatctcctctaccgttctcggcaatgctggaattgctctgtcggcgcaggacgttgctgccagctggctatatggtgtaagaagacaaggtcttagtaagactaacaatcgaagctgacatttcaacttgtagttgttgcctgtgtacatgcttcgcaaagctcaactgcgcatgaaagtgaaaatcactgtcatgttcctcctaggtttaggtgcagtgtaaggacttccattgactacgatcctatactgcgtgactaatagttaaatacaggagttccgtggcgactattatccgactgaaattcgttgtcgaagtcacccgaatccaggcggatggcggactcgctagtgctagtatcatccaaaagactttggaagcaactatttagtaagtggactgatatattatgacacctgttggcaagactaacgtagcatccagctccatcctagaaatcggcttgagtattttggctgcagcactcactgcactccgacctctgttgaagaaggtgccctgctttagcgacattagcagcggcggctactctggttcaaaagccttagtgtcttcacgatcgggaaatcgagatcacatcaaaggacctccgatcaggcttgatgatatacatacatctgcaggagacagcgaggagaacatcgttgctcctagaagggtcatggggatcaagaaggaccagagaatcgaagtcggatacgagcctcgagatcctactaaggtgcaaaggcaacagtggtagattagcgcaagagcttttagcgatcggctgagaagagatgtaacaaatctcattgagcgatttccactatacaattagataatttggtagagtttttggcgtcatttctactgcttaaactgggtttttgaaggcatatgtaattctttacctttataacatggagatttatgaaatgcataaagcaaatacaccgctattttgtctctaaagcgccagcatgactgaccaatagcagatatgaatcaaaccatgggagtatattgaacattgaactaaagtcctagagacggtctgcctaaatccaacctggatccagtttctttacatgggcttgtccgttttccccctatcaaacccatgtagtgttgtaatacatatcgattgatctgattctcaacacggcctttgaagccggaggaccagccgaccaattgatgttaccattataccaattattccagagccaatatcctggcatattcggaacatctttgctcgatttcgccttcatcacgccatcaatgaaccattcgacaccttcttctgtccagtcaatgcgatattcgtgctcttctcttgtaggatttctgggtggcttcactttaaaggttgtagccttgccgtcgccattattatcctggtttgtaaaccaaatatgatgtgtgccattgtctgatctgttgttacggtcggaaagccattcgatatcggtctcttgcgagtcagatttgtaaaagaacattcctgaaataatcatcgtgtgaacaatgccgggtgaagctcaaacgtcgctacaacataccgttacagacaccaggagtctcagtgaggattgcgacggtacgaacacttgcatagaatatgttgtctacggtcgtgattacctctgacttgtattttttatagcacgtcgtgtcagtgcctggaacagtaagtaacaggtatccatgcttgactgatacgcttttggggtctgctcctttgtcggtagcatacagacccactggaatggtgttgtttgaaaaggtgaagaccttgtgatgcaaaaatctggctctagctgcaaggtcaagtcggggctgcgaatgatgtgccggagagctaaatccccacggaagacttgctgccaaaaggaaggcagagacagcattgcctccaatcatttcaaggagtgtatcttttgaacagtatcccgagaactaacaatcaaagcatcaaaatgtgaaggtaatgagcaccgggacaaactaaagattgatgaacaggggcgggtcatcggcatggacaaagaacaatggctcagtaacaaactgtgtagctgtcttgatccacctcgattttacagccttgagtgaaagcgcttaactcattcattaccgcgcctgctaagaactgagcctagtaacgatttcaagttattgtagcgcaaccggcgctgtgttttgatttcactgggtcgacaccgcttgtggtgtttcaaactgattcaccatctttttccaggctggatgtttgacgagaatgtgttatacaaaacaatattgtccaatacatcaatggatcaaattctaaacattgattcaaataattttgaaacctaaatctttgttgagactacggtagaggagcgcagagacaccttatgcgagacatgccacaggggaacagagtatttatggctcgctgcatagtctgtgcttatttaggaggaatgggaaactatcaacagctagtcatgccttgctactggctaaaagtgaagcctttctgcctgctactgaggaggccctctgggtcatacgcaagatgcgtgcttttcagccggttgtagttagcatccccgtagctcttgagtacatcttgaccggagatagcatcattcatgaaaagtgggttgtagctagatgcgaatgtcagtattgaatcatcatgaagaagttattcagagcctaccttagatactccagatcgcctgatttatagtttgtcgggtatattccaaagtatttcgtcttgtgtagctgctggaaggtgtcggcagctgttttggcgaaggctgggcaatcctcatcgcaggccgggctggcccaggcaacgttgtattcgacccatatcttgtcaccagcttcgggagttactcccaaagcattaccgcctgcatcaatagatgcttgggatatcagccgcgaaaatggctggagtgtaaatgtcaaaagtctgaaatcgaggacatcctcaagcgcagccttggaggccagctcgtttgcttcgtcgaagtgatcctgcaggaaggatgacatgtcggatataggcatgttagggaacgacccgaaagcaatttggaatccaaggccttcgaggtcgccggcgaaaagatcttgcacaagattcgcgatcgttctcttcctggtcccgtcgtatagacttgggatagcgttgagttcgtcaaagataccttgaggcatctgcggtccatcatagaagtagaagacgatgatagcaggaatgttgactcctagtaggccgaagaaattgaaggtaggaataagagcagcctttccatcctcggtgttcgccgtgaaatttgagatggctgaaagaatagcggcatgcttatcagccggatacgtacggatgccaccccaaatttgacccttatctccgacttcgtatgttttgaaggtgaattcagtgatgacagcaaattgattgccacctcctttcagtgcaaagaagagttcaggatttgatgtggcatttgcattggtgatcgtaccattggctaacacacacttgatgttgaccacattgtcgcatgccaggccctgagacgaaagatttagcttcaaaaggattttgagaataagaaaagggagaaacttacatactgaggcgagaggtgcgaaagaccaccgccaagagtgaagccagtaacaccgacattgccaagtctgccccctactacagctctccctagagagtcgagcgaagcatagacatcttcccacttggcgccggcacctactctaaccaatttgccatcatctgaagggatagagtacttgaaatttgggtcgaatgccaaaagcacaccctcatttacactagaaaatccaaggttgggattgtgtccagagcattttagtgcaaaatggacgtcgggatacttgttgagagtctggatcgcaaaggatacctcttccgcactcgacgggtagaatatacaggcagcacgattgcgcttgctcctaagattccaatagttgacgttggtgtcatagtagagagtcgagttgagaaccgtcttgcttgcatttggccccagtggatcccaaaccaagttccgcgaatacgaggcgtagagcgtgtcacatacttcgaaagtattttgacttggcgctgcctgggcatgcaaaacaaaagaagagacaagagtaaggagactccaaaaggagacaaaagaagtctccatcctggcagtgttgttgaacttggctatggatgaagattggatgcctcgggagctgcggactcaacatgcagcgagcctgtcctcttagatatcttttctagcgatcctatcgtattcctctccaaccatcacgatgatttcgatcttcccgctgccaatcttggcctcggcattaagaagacatgacctggagcggtcaacccaggataggaaatgatacaccaaaacaagggtcatggaatgtggctgggtggtagcgatatgacgatcaacaaatgcatgctacagccctcagggattacaaccgataaatcagtccagccccgctgaaagaggaatagaggttgtggaaatattggctgggctgttccgttgatacccaacccagggtggcaagttggccaactggcctatagaaatcctcctaaatgtatgcagcatgcgatgcatatgtatggcacatgtatgtacgagggcgggagtcacttgccagctaatagagacattaggcagatacttgtgtttcttcctagggaggaaatgattgaccaatattggaccttttatacgttcgtgatccttgacagctgcggagatattgcccggcggggaatcagggccgagctgcatgccaaattggggcgtcctcattcatgaaaagagtgacggagctttcgaatccgtcaatataatgacgaaacaaccaagaggacttacccaacccatgtaattccctaagaattactaagaataaaagttccgaataatgataggtaagaatccgcagtcagaacgatatctggttgacaccgtagtaatccgcgacgtagatcaaatgattcatctaacctagagatcaatgattcttaaaattagctgagataatcgtattcagtaatagaacgccactagagctttctacagtcaaggctctaggtgaacaaaccttatattcaccatgacaacccctccactgacatatcttcatcacttcccttctgtatattttatcgaggttgaatctttttagtatttaagtttgaggcttgcctatctttaaatactaaggtactactaaaggttttcatattcaaaatgccaagtaaataaggaagatgacttctatcattttctaccagcgtaacctccttaatatatttcttttctttttttttatctttcaatcttccacggctcttctcaaagcgtagtcccaatcagttcacaaaggtgaaaatcacaacgtacactatcacaatactctactaacgaatattttagtatttgattttgctcggcagccgctgattgtggcaatacatatgttatagatatagtttttttaactattcaggtcgcgcttggcactcttgcgacctgtgataatggccgtatatgataaaatcctcatctcttcttcctttttatcctttggcgttgtatgccggaaattgtcaatctctgtaaagaagtccatcaaatactgcctctcagattcattcgcaagttctagagatggccacaaggcgggagacaacattgtcgcgtcaaagaactcgatgccgcgcagaaagctgatgtacttccacgactcaaccgcaagatccttgagtctagagtacaattcatccgcttgtggtaggtcatacaaaacagcccagtcgtagtaaatccttagattgagaaactgaaccctgagcgacaagagtagaatctcacccaggtggatgtttgatatcttgtaactcgtcttgggcaacgagttctggtcgaccacctcccccacgtccccggattgaatagcagcgcgtaaaagattagtattggcctcagcggcggtctcttcaaggtcatgggcatattttatagcgccatgactgtcctcgattgctgccggctggtgtggctctgatctaatccgatggcactcgcagagctggtcatacatcccgccgaaatggcgtgcagctacctccatggcagcgaactcgtggggttctagactactcgatccgatcttctgagtaatgttcttttggataggttgtttccattgcttttcattcaagaagacattgtcgccagtgaagaaccaataaggagtctacgtgcttgttaggttggaaaactcggcatagataaacgggcttccacgtaccaacactttgtatgtctctcttaaaatagccgcataaactacatcatccctgccaggcggccctagttgctgcgtcatggtcgaaattccccggggatgaactccaaacctcatcaggccgctggatggtaaaaatgagtattccaggcgacccaaaatcgccgcagacgccaaggtttgtaaggtcatctttttgcttctttccaaggtacgccgcaagctcccaatggcctttccgtattcaggcatatcgacggataaaacagccggaatgcctcggcggcagttagtccaaagcaaacacaacaggctcaccgagtcctgtagcgttttgctcctaggtagatacctaggtagatctggaagaaatcccatcaagaccatatcagtagttgggcggctttgaagatggttgaccagctgcgatccaatccgctctgcttgagatgttggcacaggacgcggagttaaacgaaaagcactttggtatccgtgtacgcgtctacttgagcccctgccggtgaagacggctttcctcttttccttgataccggccggtgcatccgtgtctgatgcagagacggttccctgatagaaaggctctacccgagaacccttatgatctgcacgtgggcctccgtagacaaatttgagcaaggagctgggccccggacactggatgttctttcgttcgcaggctttgcaaaccggccaggtctggtcacactgggatttgactgtggttaggagcacattgcaaaatcaagctgcgtcactgtaagaatggttttgcataccttgcgtttctgcactttgcatggcatgcagctcgttgaggatagtgtgccgggcattgtttcttgtacctaaacctccaactatacaattcattcatcgatcgccggtgcatgaaggacggcaaatggttcagtcgatgactagaggaaagaagactatcaaaaaataaaccaccaggggctcggtcccgtctcccgatttcggtattcggccggcattcagctgattggtctctcatccatgatcagccccgttattctcaaacccaggcacgaaggttctagtgctcactatgtcaccaagccccatgcgatccccaatggtgtgacgggaatttggttcaatacggtctcggggcccttccagatccttggaagcaaccaaagagacgaatcatgctgtgccaactacatggaaggattgtctaaaccgatttttggcttcaaacctcgaggacatgactagctgatgagcaatattcggcacttcgactcatattgagctcaaattagcggtcggcatttaccaccaccccgtttaacttgcccagattaggtactttgtccgtagtgtatgtcatcgccccagtcctgcgctcacctcagcttaatcaatgagaaacatccaagaaattgtaaaaatatcgccagattatcgcctataattcctgacaattctctaccgtctacatgagcaagtcactatctaatccgattcccttaccggcaaggatcgtattggattcgatagcaacatctcaccaacttggcaagcccctacgtgcatccttgtcatcacgccgtgttgccgccgagaggcccccccaagccagtcagttgtgatgaataatcaagaaagacgatcttctagtgttgcaaagttgaagcgcatgcatcaatgtgaagtgcttaccaaaaatagatcacttgggggtactcagtgaacatttggcagaagtacacagttaaacaatacaatgtatagatattcagactcacatctttgccacatggtctctgggatggtttacaagacaaagctaatgtagcatagatcttgcattctagtacagcccctggacgaccaagacgctagttatgtccccatggtcagcttcagtttcctcttctgtagtcttgatttacttaaaggagcttagctcgatgaattttggatcctccgattggatatgtaatagatttcgtagggcttcgtctagaatcattccgcttatgtagagccaaatccttcacatagcttgtcaacatggagataattgttggagggagtcacgtgtatcacccacgtgagtagaaattgacctcaactaccctatatctctaccccgacgtcaaaggcacgcatatccgtagctagcacaacctcaatgtaataattgaaaatacacaaactcataatcctgcgcaaacaattatgtcgcctaggctcaagcatcagactttgggcactgaaagacgcagtatctcagcataactatatattagagttccttgcagcaagtttttttccacattcaaatgattcactgcaaaaggatgtcctattctgggcatctcggctatatgttaaggctataggcgtgtccacgagacgagaaggttttatttcaaaggaacatgaatcactcatatccgggagatacctccagtttccctctgagttgaaatgtcactgctcgttaggcctcaacagtaaacgcgcaggagaccaaaatcagtcactgacatacctaggtacacgtaggaagcgttgaggctctagggtaggtctacacagagccggcttcttttggtcgcctcagtcgtcggctcatttcctgtttcaaattcttgtataaactataaaatagaactctattactcattgtgttgagatatcgggtctggcatcttctattgttgtttttaactttatacctgacctctctttcgtacaacagaactctacccgtcttcggggcacactattcaacttctcgtctaagataagccgattttactatctggaacttttattccattcaattagacggatttcaacaaccccacgagttttccaatgaccacatgtgcactaccgcaagccttgcaagattacgtaagtctgtattgagtgtaggcgagtttattcaaccaagtagcattacagacggaacttacgagaacgaacctcgaacaagaggcaagttaaagtaaaagagcaacggttggcaagttttttttcgcccatgaatacctcgaacttcacggtattgaaggagtgcgtagtgacagaagaatatgtgctgggaggaactcaacggtttggagagctgatctgatcttcgaatgaatcgggtgggacattaatcttgccggccaccacttcaatctgcttcaagcatgtaattttcccgagcagatactgacaaatcacatcaaaactagtacagcccatttctggaagctaaaagatttagcagagcgttacttgcaaaggaattaaacccggccttgattgggaacccctccaaaaagatgcctcggcatagatgcgggatgtgagtggggcacgggatcgggcattgaattcgtccatgtcgatccctcgctcagcagtagactgaaaagtcacttggtagcgagtgagcgattcctcgttttgatggaagacgagttggaggcatttgaaggtggcgtgtagcattatgatgatcagaagatacagctattcccggcttcaccaatgatagatcatagggttgtggatgtggtaagaaacgctcactaccgattagctgcgattggttagacatggtgttgtccccctgcttcataagcaaaagttgttctcttggcattgtggagtaaaagctctccggtctctagaattcgtccatgaccgaaagataggattttctaaaacaaattcggacatctagcctctatctatccggcaccgggatggccgttttatcagcagcggctgcagagctagtggcaatgacctgagcaatcaatatataacggaaaggggagctgaaatctctcctggatcatcaccaaatcttctcctccttcctccctcctccctcctaccctaccctcctatcagattagaacaaaaacattaaaatcacacaggatgtcgaaatctcctttaggtcaacctttgactcttccatgcggcttgcagctgccgaaccgcctcgtcaaggccgccatggctgagaagctcgccgacgcaaactgtttcccgaccacaccacagatcaaaaatgtgtactcggcctgggctaatggtggttggggcatggttatgtccggcaacgtccaagtagatgtgaggtaccttgggcaagcctacgacgtcagcattgacaagacgcgttcgcacgagacgacggtcgagacattcaaggatcttgcccggatttgcaaggtcaaaggaactccaaccctcctgcagttgaaccatcctggacgccagtctcccccaggagcagggacaaaatcattctgggataagagcctagcaccaagtcccgtcccgctcgactttggaccaggcattatttcctggctcacttcgacatgtttgtttgggacacccaaggagatgacccaggccgatatagaggacgtggttgatcgcttcgtctatgccgcaactgtcgccgccgaggctggcttcgatggcgtcgagctgcatgcagcccatggctacttgctctcccaatttctatcacccaagacgaatttgagaacagacgcctacggaggctcgcctgccgctcgaaccaagatagtggtcgatatcctcaaagctattcgcgccgccgtccccccgacattctgcgttggcctcaagctcaactcgacagaccaccagacggcgggcaacgctgaggccaaatctgagctcagtgatgcccttgcgcaggcgtctctcattgcagaaactggcctggatttcttggagattagtggtgggtcgtatgagaagccctcagtaagtgacccacgacctagatattgattcatcgtctggtatggccgtactaatcattatataaagatgatgaccggacctaaaacacaatcgaaaaggaccgctgcccgtgagtcctactttctcgatttcgccagggagctgaggacaaagatcccagatatgactctgatggtcaccggcggctttcgtacacggcagggaatggaagccgcgctggctgagggagcttgcgatctcatcggaatcgctcgtccagcgataatcaaccctgcactcccgcaaaacaccatcttcaaccctgagctgagcgacgaagacgccaaactatatgccaaaagaatcgaggtaccttccttggccaagctgttcggtgcaagagccgtaggggctggatatgaaattgtaggtttacttgatgtcgcattgagggattcctacatattgatgaatgctaattgtgtttcatagaaatggtatacacaacagctccacgcaatccagggcagtgattgattcattgcacagaacgatggcgtgatgggttttgtttatgtggcttttcaatctatctaccgctcttgatttctggaccttgcatgagcctgttgtaattaatgatagaagatacttgagaccttcacctggctcaggagtcaataatgaagttcgatatagcaacagatcctgaatccatccaaggaatgatgaaaagtgctccacaggcggtaccagttcggcttgttcgccgacagcaaacgtctcagaatccagctccattgggccaggcctcctggcaagggtcaggttgatgacgaggccagctgaaccatggggcttaaatgcagcatcaggtcgctttcaacttcagtcttgcttccattcgtctcgccattgcgttcttgatatccaattttccaccttaccacaccgccgagttgccataacgtccgcagtccactaccatcatcatgaaagtcggactggtcttcctcacggcttctggcctggctcaggctcaatacttcatcaccgcgccgctttcgacttcgatcatctcgcccaccgtgagggcttctactgctgcgtctgcatcctggtccggaaacagcacctcagctcacgttacaacccctattggaactgcttcggcctctcttaacggcacaacaagcaccagccgtgcaacatccaccaagaagacctctacatcttctacgtctgactctgagtcctccaagacaagcacggccgcccagagttcctccactaactccgatgacaagggtggctcctccaaaccgatggttggagcgggtattatggccgttgctttcgccctcgcgctctaggctcaagaacgataaatcattggatctggtcagtaaattctaggtggcaagagggcattcgcgggtgagcatgctattttagtaatgaaaagaaacgcggggcatagcgattggataatttttataccaaactctcaatacaaccttatgaatcaacagaggatcgtctaagacggacagttctaatgcaagattgacccactgaccagggaactaagcgcttcgcaaagaaaatgccattcatgggggatcaaatgagaaggatccttgagagacagggataatattatgaacttgctacgtgtagcacgccagcaagggtatgatgccttagcttctccaccatccagctgagcattgttcacaaaactcattatttccctgccactcttggcttgattccttgaatgtcttccatcgagaggctttctcgagttgttaccatcgttactgctggcctggctgtctttgacgatgaacgttgaggctctaagggtaaagagcctcagcctcgcctaccgccaggctttgaaatttacagaactcgcaaaataaagccataaatagaggtaagcttgccttggcggtaaacgggccaatcaagcaggcaaaggcacatctcgctaccaatcaacttgcacatcgacccgatgaatgtttcaactcctgcaagcttgtgctaagaataagctatggatcctccatcctgccccctcaagactcggtcgcgtgctgtttgaagccgtcattccttcgggcatcactcacttagaatctcccatcgtgcggcaggtctctggaatcgaggtgtgaggctggtcctggatagagacatcatggctaccttctacaatcatgacaacgacagcgatgctcgtgagcgtgcacatcgcaaagacaaggtctcctcgccactgattaccgaatttcctccccatcgaggccgaaaaggcgtcagcagcgaagataattcggtggccgcatatccagatcaccatggccgccagccgttgatcggttggggaatcgcgtgggcgacacctgcgctgtcaatcgcctgcattctcgcgagcttgggcatcatgctgggccatcacttctattacaagagtctggaatcgacgacggtcatgtcgacaagccagcagcaatgggccatccgaattggcacaggtctggcaaccctgaataagattgtgctgctgacactcttggggatggtggccacgcagagaatttggatgacggcacggagcaagtttgtgacgattgagggtcttgattgcatgttcaggatcatcaatgagccctcggcgctcttgagtctggaggtctggaagaagggaaagctgctcctcgttctcgcctttgtttgctggtacttattcttgttgactgctttgtattaatcctccagttgcttgactaattgctaacatcttgactctgctcccaggctcctaccgctcgccgtggtcgtcactcctgctacgttatacgtccaaccgatccaaagtatcgatacgatcaccgaccaagtccccatcgtcaacatgtccgacccgaccaactggtacctcgctgctggcgttggccgcatcacggacgccagcatcgccctccgacgcctcttctccgccatgtactcatccaactcattcctccccatcgaggccccgcggccgaacgcgacatacgacctcagcttctgggggccgtcctacagatgccagaacctaagcgaggtcgaggcgctcccggcaacgtggaacacagcttctataactagtaactattccacctacggagcggcgtggaatggtctgatcaggaagcccgtcaccaacaggaccggagcggagatcatctacaagtcggtggcgccaatgttcatggacagcaccatctttgtctggtcggaaggtaggaacgacgaatgggacaagaacccggccgtgaagaacacgagcttggtctgccagttgtacaacacttcgtatgacatctcgctcgagttcgacaacggcatccagaccatcatccccacctcagtcaaaaccacacacgccttcaacttcacagagtcagagggcgcattcaacgtcgtcaaaggctacaccaatgtcgctgcttcatacgtcacgcagatcttgttcagcaaatacttcttggtgggcgagctgactcgcggcgcggctggggatatcttgggtaatctgcctatgatgcagtcaaaactcgcctattgcccagaagtgtgggatggtctgatcgcagacgaaataacggaggattccgaggctgccagaaccaacacctgtccgcaaaagactctggctgcagcgattgaggacctgtcgaggaacttcacatacagcgtgatggcgagcggctataacctgaaatcgtactcgactgaagtccccctcacggtggtaacgcaccggaacgtctatgcctataatgagcggacgctcttggcggtctatgttgcgtgctttggcgtcgcgttgacttggctcatcatcggggctgtgacagtctacatgaatggctacgtcagcagctcatcattctcgaccatcatggtctctactagaaacaaagacttggatcaacttgccgcgggatactacctgggcgctgaatggttgccgcgtgaggtgggcaatcaaaaggttatgtttggcaaccttggggagaagggaccatatgtacatgctggtttcggcctcgagggtacggtttctctattgaagaaggggcagtaaagatgtcaagtgcctttagatgcaagttttactataggaataatgatttaatgaagtcatgcatcaccatcattctaaggtattcattctccatacgtgaattttcattcatattaaacatcaaacttgaatgaatacgtctccccagccttcgtctcttgctctatcacgtcagtgctattagagccagagctgactcgggctcctcgcgccaagctctgaccagttcccacacgaagcttcagtgggttcccgagcctactttccacgtcaatagacttaacactcccattctcccactccgcatcaacaacaaacccgcctcgcgctacgagacccttgaagcttccagtcttcgatgaaggcatcaaggccggcagaacaacgaccacaccgttgtgactctgtaacaagccctcggcaatcgctgctgtacctccaaagttaccgtcaacctgccaccctgacggtgggccggtatctagaagactgtcgtaagtcagaacgacgaggagatgctgcaaatcgtcctcaagcccctgtccattcaggagacgagagtgaagagccgcactccaggctcttgaccagccagtatcaccaccctcgttgctacaaacccattgttttagtaaacagctgtcattcaaaagaacatatcggtttaaactcactctagtcttctctttaccgtggtttcagccgcggtccagagtgtttcgttgctctgggtgatctcacgacccgggaacagcccgtacagatgggagaaatgcctgtgcccggcgtctgactccgtgtaatcttcgatccactccataattgctccagtggtcggtgatacttggagaggaggcaactgggatctcaatttcgtagctttcttcactaaatcctcatccttgttgcccagaatcttcgaaatttcaataaagttggtgaatatctcccacgcaatcgagttatcaatggtcgcgccgatagtcaatgcatagtccgagccgtccttcttgtaggttgcttcaggcgagatggatggatttgtggtcttccaccctttatagtctgaaagaaaatcctcaaagaacaagacagcatctttgatctggtcatagtgcttctcgagaaactccttgtcgccgctgaataggtaatgatcatacacatgctgcagcatccaggctcccgccaggggccagtacgcactcgcggcatatacatcttgaggagccgtgtctccccagatgtcagtgttgtgatgcgcacaccagcctctcgtaccatacatcttcgccgctgttgtcttccccgattcgtatattttatcggtgagcgcaaagaacggctctgtaagttcttccagatctaccaaggccgagtcagtaagttttccaatttgcaaatgaaccattgctggaggatagcatactagtaacctctgctggccaataattcatctcaatattgatgttaatggtgtactttgacccccaggctgggtctctggcattattccagatgccctgcaagttagcagccatcgttcccggcctagatgacgaaatcaaaagatatcgcccgaactgataatataaggtcagtaactcggggtcgtaagcatttgcgagagcttgacgccgagcacctgtttgcagggctttctgtgccgcgctcgactcgcccaacgagatggaactcctgccgaaaagagcttgataatctttaacatgattttcgcgaatctcgaaatatttcgatgacacggcaccatctagcttcttcttggcctcgttctttgggtcatcgtgagagaaagaggtctccatgtcagcgtagatccaagcctcatcagcgttgaccacttggatttggtccccgatctgccgcttcgagccgccgacgttgtgtactcttgcgaggaagaatgcctcaagttctccttctttgatcttcgttacaattgtgtcgccattttcgctgtaggcctcctcggcaaatctgttctgctggttggctggcctctgaaacttgatgtagaaactcagcgatccaggttgggaggcagtcagccgaattgccatgacaccagctggggagcttgtcaggtattcccgcctgtaggtgacgtcgcctcgggtgtagtacagtcctgccaccccttcttcgagatccaaccagcgctcataattcttagctgagccggtctggttctggaagatgatttggaagtctcctccgggcatgtactctcgcatgcttgatggcgtgccgctcatgcccaagttagcttcaagagttgcttgggccgtgtccccttggagaagcagttgctgaacacgactgacggactctttggcatttggattgatgcgactcagaggtccgccggaccaaaaggtatcctcattgatgtaaatgaggtcagatgttgggtcacttttgatcatgccaccaagtctcccattgccaatcggaaaagagtcgttccaatactttcccacagatgaggaccatagccgtagcgggtgtgacttggagtcgggagttgtgaaatcatcggctgtcacgactgccgcaagggcagtcagcaaatgcagcaccctcattagaaagttcagtgagaagagttgtcacaatatctctcaccacagtcacactcaccttactcatggtggatagaagtcatctttataagttgcgatggcccctgcttgtagtgtgccgccttttggaaccgatgaccaacgggccgggttccaattcacctttcttcccatcggttatttttctcggacttactagagccttattagccgttttttccatcccgatgatgagagtcaggttccgagatgggaggaggcggtggtgaggagcacacatcgggcaagaatccaggcatgtgagtggcggaagtattgcgggagacacggtctgtcaaaatagccggatcaactccatagggaggtcctgcaagggaccgtccaatccatgtattacgttggaaagtgccatcaatcaatagagacgagagaatgccgtcgtcgagtgttattaaaatgaatcgtctagaaaagtcgtgcaatccgagacaccaaggtagaatcacaatttcacggtcatgagagctggaggggttgttcacggaagagcaagagaactaaagttctgtgaagaaatcacacgacataacccctggttccctgcctggtagaaaacccgtccttgttgccatcattaggaagatgtactgcatcatatcacctcttaatctgggggttccccgtatttagtactaagcacggttctatccatcacgctcactgggattcaggagcaaaacttgttaacattattcgttaccctcctaggttccaccgaaagtgttgctatggctctgagaaacgtgtctaatcatcactgcccagtccattcagcctcaacaaaccacatcctcgacttgggaggcatccaaacgtccagaatcttgtacctctcatcagccctcttgaacagatccctccagtcatccggctcccgctcgcgcgcattcaccgtaacctgcatgaacatgtcgagcgtccgcatcgccttctcctccatgtaccccgcagtgcccggctccggcagcccgccgtcgttgaggatgatcttggtccccgggcgcagggcgggaatgagggcctgcagtatctgcaccgagtacttgtccgagaagccgtggaagatcatgcggaagaagtaggcgtcggcgacgacggtctggggcgtgaagaagtcgtgggtcgtcagctggacgcgcgactggagggcgtctgggaccttgccgatcgtctcggaggtgcgcatgccggctgtgtcttggacgacgaagttgagcttggggaaggcttcggcgatggcgaatgagacgtagccttggttgccacccatctgttaaagagaaggtcagctccttgttaaacactgttttctgttttctacgtgtttcactcacatccacgacggtcgcaccctctggcagacggtcccatgcgtaaccctccacaaccctctgcacagagtatccctcgcccacgccatgtgccgccatggcaagattgtaccgattagcaaactccttatccttctggatgaagtcgaaccagggcagatcctgcccatacgtgagattcacgctcgtctcgttggactcctcactccccggccacttccgcatggcgttgacgacattggcgaccggcaggcccaggtcgctgcacatgaagccgacccagctgctcatggtcgggctctcgaggatcaggcgcgaggagcggttgtgggcgacgaagcccttcttgggctcgacgaagatgcggttggtcatggcgtggcggatgatgcggcggaggttgagcatcggggtgtcgaggccgttgttcaggttcttgaccttggctgtgaggtcgtcgtacgagatggtgccgtcgagggggacggcctgagcgatcttgaagtcccagattgcctggagcgagaggttgttgacgccctagaacgagagctcgtgattagtaacaatgtccctttcatcgcgatagtcgtttgtctctcatttgaatagttatggatccaattgatgatgagaactcacatcccatgccagatagcgcacgctttcgctggggccgagggcaatgtcatgcagctccttggtcagcgcaatgagttcgagacgggccttgtacgtctccccttcctcaattgggatgggaaactcggcgagtccattgacatcaaaagacgcggcatccaggttgttggcggtgagatagtcggtgatgatcttggttttggcggcaatctcctgcgagagcgtcgtcatgcgctccactgaggcgggagccatgtttgcttgatacagaggattcgattagcagagaggggccagcggaaatcgacgaattatgcagctaaatgaacagctgttggtcgttggtttggtggaatcgtggaccaaagtcctgttagtgggtattattagcaagttgatcccgggagtacggtacaccaggcttatgaggaatgcaattattaataggatatgacccgagggactggaactggtgggatgagcgagggggccaaagatctgtgtacttggtctcggattgtcgcatcgaggagatctacctcctgagtactacccaacagttgccgcggcatgcaaccacgagcagctttccttgaacgaaacctcctttttatgatttatctgacctaatgcctgccgcctgaaccctctacttccaaggtgccccggtaagctgggtgggctgggtacgatggctccaatctccttgtaggaaacaggtggaactcgcggactatttaaaaggcgcatagttagtccaagcatgtgccactccatcagggggcagctgtaacagctgctttacggattggacaaccccgctcgtagttgtgaggcggctagtggaggatcagcccagacggctgctccattccgctcatccaaggaatggagacgaaggcgatcgggcctctggttattcccgaaggagtccttggcccggaggggaggggggttcgtgcaaggagacaacaagtgggcacgggcatgagatatgagatgtgatgctaccagagtatcaagtcagttgccagagaaataccaatggttctgcttcatcaatcgtaaaatacctagccaagaccaaacccggggagacgactcccaaacccttccagcatacattcatttcataaaccgtaccgccttttacaagggcttctgccctgtgacagcggtgaaaggaatatgcgtatgctgcgtgtagtcatagcactccttcctcaccgcaaccagatagacctcaatctgctccggcgtccacttcaagccgtgtaggaagggcttgctagacacgccgtggagggcgtccaccatcatggtcctacagtacaaaccaatcatgctcatcctcttgtccttgggccagatgccaaacgggatcttgagcgccttctcctggacgttgacgaagccagcgtcaagcgtcctctgcttgttatttcgcatcgacagcatgtccacgccaaacgtcatgagcccctgacggaccaggcccagccactcctgcagcttgttgtcgggcttgagggaaccgtcgtcgcacttgagctcgaagcacagctcctgcagctcgatccacccgcccggtttgagggcctcgtacgcgcgcgacagcagcgtcggccagtcgcggatggcggccgtcatgtttcggatgtggatgtagtcgagggagttgggcggctggacccattcggcttcggcgtcgtcgaccatgaatcggacgttgggcggcacccacggcgtctggatgggactgaggtcgatgcccaggatctccgcctcggggaattcgtctcccactgtcaggcggcaaggttagccaatgccaatagcgcgacgggacgctgcctgtctgtctcgcaaggatggaacttactgtcaatagcccagatgcccgtgcccgtgccaatgtcgaggatgttctgcgggttgtcgaggggcgcgaagtgcagcttgccgtcgcagaggtgaatcaccatggcgtgcttcatgtcctccctctcctgctccggctcgtcgttggggaattggtacctcccctcctggaacttgtgatatcgtctactgttctcgaattcatagtcgcggatggagctggtcaccgacgtcgatgccgagctctctctgtctgtctcgtagccgtcgtcggtaagtccggctcggtcggcggggattatctcggctgcttcgatcggggcatgatcatcttctgtgtgtgatggctcgttggattgtgtcggttggccttctgctgtcccggtcgctgcaggaggactactggtcgtcgcagtttgtgctggaggaggcattttctctggggattgttggagccgagcgcgtggtgtcttgccctgctccctaagaagtatcagcgtctagatagagcccgaggcgtatccagacagtgagggtctgctaggaaacaaagtgatggagaagaaatggatcaaatgacgagaggatccgctgctgcgggggcttctgataaatggaacaacttcaacaggcggatcggagtacttctctctccccggagtggaggaggtagggctagctgaagccctaggtaagtccatggctgtgttggcttcaacaattaccaggatccccgtgttatgggctgatcctgaaggagcctgcctgatcaaggagcactgtaaccgagggagggaggagagaacttctgagcctggggccgcgtgtcgacgcgaggagccagaccattcctcagcccagacgatggcagctcaggtgacggccaaatagcagccacgtacctgattccatctcgtagaagcgtgcttatgagcttgttagagtcgcctagtttcttagtgtgcgccgcggaaactctcctgcgagatagttggggatcagtgggacgggccaggggtctagactccggacaatcatgttgtccctacagcacacgctgccctccagattgatttgcgaacagacccaggccagtggtatcaattgccgatctcttccacaagtagatggcgtacttccttgaccatgaagagaaccagcattccagtcaagtcttcccagatttgccaggaaaagaggaaaagaggagcacaattccaggtgtgtatcacgcccattcctcactatcagcatcccagcccgaagctgacacaccaacaactgctgcaccacactgcatattctcattcttgactgtaactagcttccagctggggccagagtatcctggcgcttcactctgtgccattcccacatgcagccagcctgcataaatgaacagttctagatgacaccagggcctaatagaccgctacgggtctcactgtaaattttccgagtggcgtcaaccagcaaagcagtgtctttttaacattgagagagcagccaacggccggaaaaccccggcgttttattcaacttaccctagaccctaacgtaccctcgagagaggtccgagtgatattagacaaaagaattttatatcgcagattacttcataaggcaatttagcatttctattatagaagtctgttttaccagtatgtataatccttggaatgattattgataattaatactatttattacttcttatctatgtaataattgaacataacaacctactgttataaattaatacagttgaaagactttcctaagtaagcagtaacaatatatctctatctttatcctaaatactatctataacagcttatatacccagatcgtagtccatctctaactgctcaaatccttcttcgcaattactatgatcatctcaactgcttattaaaattgcagccattccaagatcttacgagccgctgtcaccctaccaccgccgtctttgctgcagatttcggcgatttgtctagaccgtgcagtgtattttgcgttgttttcgatggctacatccaccagaatcggcgcgaattctgattccgtccagcgaggacaaccctttgggcttccccaccgcccaattccgaggagttcggctcggttggcgaagtcataggtgtcaagccagcaagggacgatgacctgcggtactccagcgctgttttgtgtcagcatgggtgaattttttacgcaggaatttagatggagggtactcaccatacggcctcgtagaatgaattcgcaccaccgtggttaatgacgcacaaaactgtccccgtccccagtatggagtttggctctgatgatagccactgaacaatgcgcacggtatccttctcaatctcagagccgagaacctcatacaagacggacccagggccagtctccaagtctggactgcggatcgagtcttttttcatcttccacagcacttgtagctccttgccggacttccgcgaatggtccatcatccgcctcaaggagcgtgccatgtccaccgcctctgtttcgttcacaacgcaatgagagcctagattcaccagcacagtaggtctgcgttgcagccatgccgaaagctcgggttctatgggctggatgggccgcacgataggcccacaaggcacaatccttgcccagtagtcttgcggtaggttgacgagatccagctcggggaaatcgacctctgcccggcttccgatgaagattttgtcgatacctttcatgttgttatggcaaaggctgatattctccgcgatctcaaggtttggtgagccaacaagctttgcgaccttcttccccatattcgccacgttcttgttagttagcacgagccagatcatgcgaaggacgaggtaaatgttgaacgggacccaataccacggaatcggcatcatgttagcagacgcaacaactggccacttccagaacgctgctagccccggctcgaggtgatggacaaaatctttcaagctgttgggcgaaaggatcgctagcttgtaatccttggacccatcggctcggatatccctggccgcagtgatggcgggcgtgaaaatggtgtctactaggacgatgtcaggtttgacatgatcgatagtggcgtccacagacttataaattgaggcaaactcctcggccgtccagcagagaaatgcctttgtcatgataaatttttgcgaattaggcgagttccagactccaggcttctgcagcgagacggtgtggatattgttgttcaggtcctcctcctcctggaagcatttgaacattgcgcggccaggtagcggatggaaggtgaacggtgtagagagatggtcgcctgcgccgccgagagcatcgcggagagtttcttgcagcgctggaaatgaggcgaagtgaatgtcgacgcctggattctcttggagcagggcatgcgcggtagcgatgaagacgttagcctgcccaagctctgcatttacgagcattagcacctttggaggcgccatgatgattcccgatgctgcttggatgactgtagagggcgacatataaatgtttgaaccgttgggtcaccgcctcagggccccttttgtttaagtacgggcaaccaagcgggtctggaacttgccggccactttaatagtttgcaatccgcactcggatcacggatctagctgctgcaacaacccgggacgagagattactaaaatctgactgtgtcgcatagaagccagtctgatccgccaatgcttacaactagcgcctcaaatattataaccatccaccatccgagagcagtcggcaacgccctttccgatctcgtttgaaactttctctcatctcggggtcgcatgcagggttcgcgtattagtgtcagacaactggttgtattctgttgtatgggtgtggcgccgtgggcgacgcctgcattttcctgcgggctattctcccgagatatacaaatggcggcaagtcactatctagttgttactagggtctgtagaggtaaaggtacatgcccccatcttctgacaactagtattctatctccaagcggcaggacggaacttctctccgtgggtagtgccaaagaaagccctccgttcgtagacgtgtcgcagtattcataccttttctccacgatctggtcttgatagcatcattcagcaacttagccagtcctcgatgccgaactgacaacacatcatgtggctgaagacgagtgaattccccgttttcaagaagccgcacaaacagttgaaattgttcctgaacttgccttgtggagtacacggcatgaatccctgaaaacactgcctaaaaacgaataagctttgttttctccagtgcgaaatgaaagccctgaatcgagttgtctgtcatccaagaatagcatgcgggccggaggaatgccaactcctctatcaagattctactcgcttcaaaatctttagccatcgttgacatgacgtattgcatagtttgtgttattcccacgcaagctcgatgcagtccctgatcatatgcaatggcgagatttgtagaggttccgaaataaatatgccatcattgtagactgcttcgagttggctgaatactccctgagcttgctcaagatcatttcgtgcgatatataaaaagcaagactcaagaagtctcttctcctcttcaaagaaggtatcctccaggtggatttgggaaatccagcttgcgtcctggccttgagactcgtgtatctgtatccacttccacagaactgcttcactatggtccatcaaaaccttcctagactgctaggttggccctcagagttatcccttaatatgcttggatttttatggcagtgcatgcaagaggcagaaaagtctgtctagttagccgtgtgcctgtgcctaaatcgtggctgatgctcccaggatagaatgcactttcgtcaacatagcatcagctacagtagtcaaacagtgccacgcaacccaccacaatgagtcatattccagtcttgtaatcactcttgcccttcaatatctctgggataaattagcccaaaagctcacagatgtatctgaactataggtgcacgcatccaataaggccaaattcgaggactatcattagtaggtgccttcttgctcgatcgtacttgaagaagcaattcagggacttcaacttacctgaattaggatgatggaagaagcagaaacaaaattatgtaaccacttacgtcaatcaaatgaacgccgaactcgatgagttttgatgacatcaccactccgaagatgcacttcatcgaagcacggcttcatatgaatcgtacttaagagatctttgaatttctctgcacccagttttcccctagcaaacaaattctctcaaccacttctccaataaagacatcaatgcacgcgtaaggattttcaacgcttcgacatggccagatcaaaccaccaagaaggggaacaaagcaaaacaggccagaaacacgagacagagcacgagccggcgccttctgctcggcgggtcaagactgagaaacaacagacgttggaggaatcgctaaacaatgacaaaagtcttgagaacgagaaagcagacaacatcgcatctgaacaagtggacaagccggaggcccggaagcaaagcgccgtgaggccaggagaggaaccagatgttccacccaacatacaagagaagggcatcatctatttcttcattcgcgggcgggtcaacattgatgatccgaaaaccgtggacgacgtcgcgcggacattcatcttactgcggccaatcgagaaagatgccaagctcggcgatggaccgatcggtgatgcacgtaacaaccgtctcctcgcgctacccaagaagaaacttccgcgtagtggaaaagatcgcttcatgattttcgtggagaagtctaatgcttccttcgagaatctgaagaaaagtttcttggctggagcagactatgaaacgaagacagcgggaacgagacacactcccgcggccaccccagttggggaaggcgtatatgctctcaccagtacaggacgagagagtcatttggtctacatgctcacaattcccgagaaactggattccgcgcaaaaggatttgggtataaaggagaagggaagtttcataataagtaccaaaaatccaaactatggcggaccggcaagtgcaagactaccagagaatcccaagtttcctaagaagtatgccctcattatgcttttctacatcctcacttcgttaacgagatcttagggttatcgacgaattccggtccctccgatggctcccttccaagcctattcacctagactacccgaatgctcagctactcctcgtgggagagtcttctggtatcgaaaaagctctagaaccacaagaaaaggatgatgaaaatggcgcacagaagccggaggaatttatagagagccttgcagaggaagaccttcaaagaatgagacatctaactggccagcaatcggaatccatatatgccgatctccaagctcaagcagagggttatcctcggcttaagacaaccttctaaatgccatttaagaatgaatatttttgatgaaaatgataaagatttatcaaattatccagttccccttatatatgatcgttatcattacaattttacatgcggtacctcaatagtatacattctatatagttggtatttgcctttttcctagagaattttaggagggaagtcacagaaaaattcgcatggcagggataataaattatgagggcgtgcgcgtaagttctcggtacaagaaatatctttcgtagatcagcgaggtatgcagagtgggtgagtgagaaaggggtcatgagaaggtcaatctgacctcacttatcccggcttccttggatgaagtagtcacctctccgttcttatatctgatagaaaactactcatctttcatttgaggattatgcaattgaaattgaaaaattaaatttggacttaggatactctactttccactcttcaagatgcctggccaattcattgacaggcccaatccaccagccttaccaagcgctctccccgaggagacgctcgacctggcggcgaagattgagagaaagccgacagaagaagatgatttgaaatctctcaaagatttccagcgagcagcatgctacatcgctggtggtcagttcatctcttcagtctcattgatggtgctgcggttaatgaccaatgatatagcgatggtattcctcagagcactgctgccagggtttcatgcagggttacaccctcaccggtcgcaccgctctcttcccgagctatgagtcttttctcggtattgtgcacacgatgatggttcaatattgtaagtttagtaaactggcacgtcagactggttggcgccgtgacattagctccattaattacatcggaacaagcacgtgggcttgtcaggagcacaatggcttctcgcaccagaatccatcgttcatcggtgcggctctcaatatcaagggggaggcaggtcgggtctatcttcctccagatgcgaactgtttcttgagcactgtggatcactgcctcaagtcaaagaatttcgtgaacctcatgatcggatccaagcagccgacgaagcagcagagcattgccgcagaggcgcctcgatctggaactttgcatctaatgaacgggatggacagaagccggatgttgttcttgtcggaataggcgttgagatgacgtttgaaacggtaaaggcagctcaccttcttcgcgagctcgcccccagcctgagtgtgcgcgtcatcaatgttacggatctcatggtcctcgctttagagtctcgacatcctcatgcacagacgcactctgaatttgttgaaatgtttacggaggatcgaccgatttgcttcaattaccacgggtatgcttggtggcccatccttgtaaacgaggtcagtataaagatcaatagcaatcgtgatacggcactcacgtttccaggactccttacaaatatcgcttacccatggccgagtagtacggtccgcgaatctccgtcacgccgcctttcgcggttttggaggtctgctgttgtggtgaacaaagccaagaccatttttgtcttcgagcataatctttggggtttgtgtagataggctccgtgagggaatagagaaacgttgatatcgcgccgcgccgcggcctgtagccgactttaatgcgcgcgggacaagtctggatagcatcattgagtctgataatcaaaggagagtttgtcttagtctcagtttctagttgaccagccgctgacgattcaacgctgccgtggactgactccgtcggactttgtatttctcagacaagttggatttgtttggtttatatgtacgttagatttctcgagcaccatgtaggccgaggtcgtaggtataaaacttcatctcgtgataggttgcacttgacaacgactttacgtcatctccttgcaaataaccttgcgaacatacagacgttgtggtgtcatcatttcgacattcaatatcaatcgcatgattataccgttaacaatggcgatgatcagtcaccggatgtaacattaagtatatcttgtgaatcactgcaggcggggtaacaaggacgaaggtgcgctgatttgtcggcgtagttgatcttacggttttcatagttggagcttttgtagctacgcttagggagaatttgagcgtctggaatcgagtcatattcaagaaatagcttaattttagctgcgtgttcatttatatccccatacaaaagcggcgatcagctgggactataagttcctattacttcgaaaaatcactgaagctctgttaagcccaaaataggtgtccatatccaaaggataggtaggatacaatcaatcggaaagacggagtgtctttattgatgaatagcgcccgagaagacgcttccacttgaaacgtgagatctaatgccttctggactcgtttccctccacttgcggcgtaatatctccaagactttttatatacaggaatacaattagtgggcttagggccgcttcttacagctgcaataactactactgtgccttcgcccccccgtatgcctgaaacagtcttgatcctcctctttaccaaagacccattagacgacaccactgtactgatcttcagagacgatgccgccaaggcaaagctccactcccgatgccaatcatctaaccaaacgtaatggatggggaggtgtctgccgttgcgctcgtgacggaaggcatcagcttccgtactatactttcattacagaccgataaaatattgtggcagacagttaatcgcagggcagacactacctagtgaccgagtgatttggacgagtccggatatcactcatcgagcttcgccgtggtggctgtacaatcctccggcagtgatttaaaaatgaaaatgcctgacaagtcacacaaaaagatcactgcaggtgggtagcataggggctgtgctgtagcattgcccacgaccggagaggtgagtcgatccgatatatcgtttttttgtggctgtgctgtctgccttgggatgttgtgaaagcgcaaatacggtgtttccgtgtgttttgatacgaaatatgcacatgtctgcaggtgagcagtgagtacagtaacaccgtggtggctgattgtgtctgcttaggggggtaagctgaggcaatgctctgtgcttctacagttctactggctcgctgataggtggctgtttgattggaagacacgcaacgaggctttacgcggcatgaataataaattaccctgcttcgctgatctgacactgacacttccaatattgttgtttcttctgttttcctgcagacggcgatggttgccctgtgaccggaggcgatcgaaatggaagttctcggcgccgtggcaagtgctgccaccttggcccagattgcggtcaagggagtcgagttcctgcagaagattcctgagattaaatccgactacgccgagctctgcaacgaggtgtgtactccatttgaccagagtttgttggttggttctgacctttgtaatttctcatcagcttgaattcatcgagacaatcatccgagttgcccaccagacgtcgacgcatagcgagaagacgaccccgatgcggggaatacaagatcagtttggaaggattatatctacacttacagaaatatcaaggggcctggatgaaatcaagacaaagtgccagcaccagacagccacgggagacgtgcgggttagcaaaaagaagtggatgatgttcggcggcaagattggcgggatgctgcaaaaggcgcatcgagcaaagacaaatctacagatgtcgattgccatgcacatgtccacgctacaccatcaaacgaacgcggagctgcgagaggtcaaatgccggcttgacatatcattacctgggattgagaggcaacttgaccatatgtcacatgctgcaatggtaatgatatcgacccaagagcagattctgaatggccagaccgagaattcgcagagaattcaagagctggatgacgagggaaatgagctcgacagtaacaacacgagtgcaatcacggatgtgcagggatcaataacaccagacgcacctccacagagtctgtttggtcaaggaactacgttgggggtggttttccacaggacgagttgtccaacgcagtgtgtgtgccgatgccacactcgtccacggaagttttctagcccggaatggataaagaagctggctggatcgtgggaactacagtacaagccacaactagctggacttcagtgggatatgcgttgcccatgcaacaagtcggatgatctggagattgcatggcgacctccagaggggtggtggatacaatcttttttccctcgtcccaatcgctattctctgaagtgtgcgctacgtccagctagagtcttgccatgggcgtcagatgaatacggctatttgaacaagtccgtggcggatattcgtcaggccatggataagggaatggtcctattccctgatgatggattagaaaacggttttgatatcatcgaggtgagtacagacgcatcgatattcaatttgggaagcgggaacagctaaccgccaaaaaaagtttctagttttgatgaagaatttccaggtcttggagtttctattgttgcaatggaataatgtgttggtaaatgctgggctctctaggtactatgaagaatctcgtgacagtagccaaacaacagcaccaaggctaacattgaatcactatacagaaatgcaggatatcggacgtcgtatttattgaggttcaatttgataggcgagccaggagtacgagtgctagaacaaatcgtctcatatgtcgacttggagacggacgtggcaacatcagcaattcacgaggccgccattctggggtcgggcgtgcaagaaagctatgttggagcaaagcacttgatcgatgcgttggatgagactggatatgcgccgttgcactacgcagcaatcagaggccacactcaggccgtgcaggatttgattgatgcgggtgccgacgtcaattgcaaatcattcgaagaacagactccgttgatgttggcagctcttcatggcccgacggaaaacatgcgaaggctacttttgacaaggcggatcaatcgcattgatgaacgagacaggtttaagataactgcactgcatattgctgctggaaattgtgatcccgaggcggtgcggctgctgctcgaggccggagcatcgccgtcgctgccttctgattggggcttttttccactgcatcacgctgtagaatctgagaacgagaatccagccgaaatagcagccactatcaacttgctgctcgatgcaccggggacagacatcaatgcaacgaatgattatgggcatgcagccataatgctcgccgcgagggataataagcatgtcgctttgcgttgtctggcacaagctgggccttctttcacagcagtgcacaaggattcagggacaatactgcactacgctgcccgttacggggatctagaaactttgcattttctcaacggccagcaattggcttgcatcgattggaggcttcctagcaatggcggttggactccttggatgttgtttatggatcgcttgaatgatcccgaacggaagacagatccagcggaaatgattgcctttgtgcagctgtacagaggcatacgggatcgggatctcgcccacgacatttcgctcttggaacaaacactcgccgcgctagaccacaacgaagtagccaaggctcatctctccctctccgcaatcattcagtctaaagaggcatataatgataaggatagtgctagattctatcgcggctttagggggcatctatcatgcggcaacaaggaaacactgtcggacaatatccaggcagatcttcaagagctccgatttgagatggcgagcagcccttgggactgggatcctttcgatgaatcagaatcagatgagtctctatcagattcagacgagtctctatcggattcagataagtcttcatcggattcagaggattttagcgaatcgtccatacgcacagaaagtcatgcaagcaatagggattaacttgacagtccataacgttactgtttataggaaatgcggttttcttccatgcccccaggagtcgtcgtcattagagggaaaacaagcaacaagcagaggagaaagttagctaactacgaagcagcggttggttttctaacatagccacccctgtgcaagacagaaatggagtgttgtgtcaaattacccttgatccgtcatctattgtgtattttgggcacaaattttatgtcattcccgaaggctatgtactttgaaatgttcatcctgccctcctcgccaatgtccagactccaatgtagtggaagtatacaaactcgcctagaatgaatatcggaacaatgggctctcgtctcccatctctgcaagctcatcatccgtatactttgctctaatctcatcctcgctcatcaacgcccgcttttcgttgatgcgcttaagaatgagagcgtacagaggtggccagatgcatccaaacgcaccaatcataccgatgctgataccgaatccaactggatattttggagcagtactggcaatgtagacgttggacccgacaatctaagcgcgaagattagcacagcatcaatagtatggtttctctccagtattactcactcctccaagttgggaaaagctgatcatcgcgccaatcccgacggctcgcttcattgtccctgcagtgttcattgagatccatgccgttgccagcggggatactggataaagaccacccgtagccagaaaaacaccaaacagggtaactcccggaatcgaagggaatcgcacactgactaccatgacgatgaaccctgcaagtgccatgaggtttgacagaaggagaggcagcatccgcttctgccaccggtctgccatgtaacccgagagcgcagtaacggcgcacgcaaatacatacggcggcaccgtcatggcttgagcgttcgccgcagagtagccgagatcacgaataatggttggcagcacgaagttgtacccgtagacggcaacgcagagagtaaactcggtgacggcgacggcatagatgtgcggcgaccggaaggctgcgcgggcgtgcttccaggaaaagctttccatttccccgattcccgtttcgccgccagccgagaacttgtggcgtagagtgaggaactccttctcctcgggagagagccagctcacgctgctgggggtgtcgtatacaaaccagaaaccggcgatggcgagacagagactgaataagcctggacacggggttatcatcagacctccctcagcggcaagtaggaaaacaaaccctcaatgcagtagatgaacctccacccgcgatatccccaggtatagtcgagttgaccgataccatatgctaggagtccagagaatgcacccgccgcggaggcacccgagtagaagaagcccattctagcgccgacttcctcgggcgaataccactgggtcagaataaacgagcacccaggaaacacgccagcctcgaagagacccaggagaacgcggaaagccgcccagccagcgtagttctgttgaagcgacgtgaaaatcaagatgagcgaaactgtggtcaggagcacagggagccatatcttggggccgaagcgcttcagggcgatgttggagggcacgccaccgaacgcatacgttacaaagaagatggaaagacaggtattccactgctgcccactcaggccgagatcctccatcgcaccgaacagtttcgcattacctgcggggggggggagtttgttagatgatacttgtcccttgtctcgagtgcttgggacggttcaaatacttactgacgttggttcgatcgacgtatgacatgagatagatgataatcaattgcggaagcacgcggaaactatcatgttagggacatcgcttcagaatgagacttggctacttactcgcacttgcggatcagcttcttgagcttccctctagtgaactcatggctcagttccaggaatcgattgtactccgccgaattgttgctgctttctcccaccttgaggctggaggcacagtcatggccacccttctcgggcttggtctctgagttgatttgtgatgcttccatcgtgttgaaaaggaaaactcgtcttgaagatgcgggttgtcataacacttcgactgcagtgatgtcgcatagctatttgtaccccaggatctccaggtcccctgactcagattcagttacgttgaaacagttgcgtagtttgtggagccaaagatcaaaaacctcttgagatagagataagtgccaagtcggcaactaacgtgaattcccgataaactacgtattggatgagcagatacgcggctgtcatgggtctccaactaagtaaggctcgggaaatggcgcctagcgtccgagccagccccagtcatgatagtcgctatggggtcacacaacccgagagggatcaatcacagcgtccgtacgtgcccaatgcatgaatacctgcagatcgggatcttttagagccttccgccgatgccggaccaggcgtttgacttatcttaaagggtgccgtagtaaccgctatctttctgcttttttaatagtctgtgctatcaagcgagccgttacatatgagcctgtcctcaagcgaattgtacctagtcttcctcctggccctaaagttcagactatcgattcataaaagccgtcaagatgcctaaagttactattgttggcgctgggtaagttctctccggcccctatcatacacgaacccctctaatggtcctacagcatcgtaggcctaaccgtcgcgagcctgctaccaaagacatgcgagatcaccgtcgtggctaggaacttgcctggcgacgagctctcacacgaatgggctagcccctgggctggagccgtcttcctcgggctcgacgggtccaaccctcgtgagcagaagatgcagcttgattcctttgccttttggtggcaacttgccaagactcatccggagtcgagcgttagggtaagagtggcaatccgtgatgagaagagaagtgacagtgctgacaacgcgatacttttgccataggcgatcgagatgaatgattttcaagacgtgacaccgcttgagaaggtttggtatcgaggcaagatgccagaggtacgtggaacacaaacccttctaagaagacaggtagctaaacagttcgaacagttccgcgtaatggaaccgcatgagttgccaaaggacgcaaagttgggaatgagctgtacgtcgtccccccctctcttgtggctacttcgagattggaagctcatactggtgcagacaaaactgtggtcctgacaccgcacattttccttccttggcttcgccaacgccttgagaaatccggggtcaaattcgtccgcaagagcctccaatcccttgccgatctcaagggctccggatacgatgttctcatcaacgccacttcgctcggtgcgcggtatctagcggatgtggcagataagcacatggtgcaggtccgtggccagactgtcctcgcaaagaccagctataacaaggttttcatgcgccatggaaaggactacacctatgtaattccaaggcttgatggcacggccatcttaggaggtatcaagcagcacggggagacgtaagttcaaggaaaaatgaatagagagcacaacagggccacttaccacgtcgataataggcacaccgaggtcgatgactatatcacagaagacgtaagttttacctatgacatcgtaacgccttctctttgttaatttcgggatagattctgcgtcgggtgcacgagaatctgccggagcacttcaccagccccaagccagcggactatgacgtgatccgtcacaacgtgggcatccgccccgacaggcccacgggtgtgcgagtagagaaggaagtcaaggacggagagaagattgttcacgcgtatggcacaggcggcggcggctacgtgtttagctggggtgtagccaaggaagtgagccagctggttggcgagttcctgttcgactcccctacgcccaggttgtagatgattttccgacatcaggcggggcttgaaccatgattgctatattgcgagtttcagacagagattcattccaagactagatggtaaatttacgaaattgccttagagcctaaatgaataatgttgtctaaattatgggtaaaaatgaatagtagtaaataagattcaaggcgtctatcacagaggctatccttgaaatacattgagcttgtttgtagcttaggtctgaaacaaggttactttcactcctcttgtgaataatagctaaattcttacgggttatattgaactgttaatcataatgacacttggcgttttggatttattgcatgcacaatctttgcaaattaatacgtcccagtggaaagatatcattctttgttactgcagtacaggacgccgagtgtgagttaccggccggcttgcgaattggcccgagatcgctcgtggacctctttctgagggcgggaaattggagtcagctttgacaatacctatcacgttgtttctccagggttcctagctcgccatgataacgcggggctgttgccactcggggagcatgaatgtgtctggacatgaatcgataacgccgtcctcttgttcccattggatccgagacccttcacaccctcggcaaattcccccctagcgtccgatatcatggcggggaagtggaaccaaagccagaggggaaaagtcaaggccgatgtcaaccgttggagtggcgatagtttggactaatccacgcccaaaaccttctgcagctactccttcagctacccacacgcggtggcaatgatggtcctaggcgagatccacggaacgcgatggttcgacaggcgagtcgccgacagtgaagccacgctggggatctggaccagggtgcgcgccgaggacctcgatggcgcggagacgtttgcacaagacgtcgacatcgacggtgtactttcctggttggccaacattgaagaaaatcggtgcttagatccagtgattgcctttattcgtacgaactcctagagctgatttaaataaatcagaagctagcttcaatttgagactggatgttagagtgatgtgtctcgttagaaccgactattcacggataggaaggagaggctaatttgcttcatcagatcaacgaaagcatcaatgcggccatgcctccgtatcccaaaagttgaagaggtcaaaagccgtattatccgtccagctcagtgcgtcgtgcaaagtctctacttcatccagcatgcgtaactggccttttgaagcaaggttccccgcctgggccatctcgcccaggacacccttggcagtccaatacatcgtttggtcgtctggcttctcctcgaagctgcccggccatctggagtttaccgaaatagcgagtgacaatattgtaaggccggagaagagatgcgaactctcccaaaacccaaacatggctagagaatctgtattagtttacggtgattttttgaaaaggctgcccatgttaaacggggcactccagaatgaaaaaaaaaactcaactgacccagcttctcacactgttttagatcaacgatgagcaacaaattgattcttgctgctcggagacataggttggtcagatatttcaagctctcttggcacgcattttctgtgtcattcatcaacaggtagttgatttccttcaagaaaaatggccgcagcaggaggacgaaacacttttaccattagtgattccgctgatgggcgatgagggagggagagagactctgaagtatttacttggtagtatctttcatacagtgacacgagtgatcggtttttcatctctcgcatctccgtcggcaggccgttttcgacatcaaacgacaatgcaggaggcatttgtgctcttagagtctccagctgctgtatgataggctcagcccgcttctggtcgtatatcatgccggtatcccccaggcttctgaccgtctggcagatgtcggtatgtataaaggcaagttggacctgcgttgtgaacgccactccgctggaaaactcgtcagcagcctcagttgggagcatctgatcgctaggataggaaagctcgacttcgtcgcgacggaaaatcggcgggaggcccatttccgtactcgtcatacgatccaagcagtagacggtccaccaaacgcgcttcatatgctcggattccacggcagagagtgacgaagatgaagatggcttgtgcaagcgcagaacatttgaaagccgggcagacattcccgcgtacacgtaggcagactttttgcggttcagactgtacgagtaaaatgtctgaaagagaagtttcagtcaatccagtcatccagacatgcactaagccaatgatattttgttgccaaaagtaatggagaagaatactcacaattaaattgagtgccataatctggtcgatagtcggatcctcatgactgatcttgagaagagacatcgcttgctcgaagaattcggtgccgggcgggcgtcgtgagtctaccaggttgtcttcatcttgctccgagacgcgacccagccggatttcaggaggaggcccgacattgtatgactctcctagagcaaatacggcgagcaaagtgcagagccagatcctgtccttggcttggggagaggttggactcctgtaagttaaatcaaatctcgttcggaaacttttgcgaagaaaccaatgccaatcatgacccaagaatacgtcgaattgatccagcaatgcgcgggcatacggatatggaggcagcctaaaagaacatggagtgtctaacaccaattaataacaacatcaatatgtgaggagggaagttgaggcgccaacgaaccagagttgtcaaattttagctgaacaaagtcgtaaggcgccgtcgccggactttcatcgtcagtataagggttagacggagtaagttgtgagaagctagggcctgtattattctggcgtatctgcttcagcctggcaaggaagacctcggacgtggagtcttcgacgagtggcagcggtggcggcaagccctgactgacggttccacgaagtgactcaggctccgacgagggtgttgcttgagggagctgagtgctgtggctaagcgctctggcttccaagttgcgaataaagcgttcagacacggtaacattgcggtcacgcatgggatatgtgcattcttggttggctagctgacagttgcggcacggcagctctgcaaataaagagtaagcaacggttcacgaaaggtggcaaacacgccagcatcggtgtttcaatccttacctcgggtgcacttcactttgcgcttgtggcatcggtggcaggctgtgctgctccggccgagtggtggcatcgcgaaatgtagcagtaggcacggatgaatacaggtatgctaggatgggctgtacagcagcatttccacctggctgagatgctaatagatgatggctttgacaggctgcatgtaaggtggaggtatctgtcatatgcgggatttccatggtgggcacagtgttgagattacagcgacccctagcgtcttagatccatagctgttagctgttagctggactttagcttcttaccgccttatattttgctattcgtctccagcgcaaccgagagtgatattactttgagttctgaactcatccccttacaaatataagtctatacaatgaaaagaattctatgattttgtactgactttatagctattcctccctcatgtgctccgccagctccctcttgaccttggacatgctctcaggccaccatctctcccccgcgtccatcgagacgtccgcccactcatacgtccgcataaacgacacaaccctctcgagctcccactcaccagtcccgcctatccaccacaccccgtccaaaagtaccataaacacaagccagtgcgcaaatacatccatcgccagcttgtggaccggactgggtggaaactgctcctggtctatccgtatctgaggctcactgtaactgggctcgataggcatcaaatccagaatagactgcacaaaatgcaggtactcaatggggatcctgttcagaaacgccgtgatcgtcctcctaagcgacttcgttggcgttgaagacgtcactctggccgagtacgacctcagccacggggagacatgccgcagacgacccaaaggcggcggaacctgagcaccagccataccaccgagaaactggggatcaggagaactgccatcgatagtgcagtagacggtatcggcgacgtcctgcaggatttccagcgcggcaagcgtggcatccaggtctgcctggcaactggtgtacgactgctgctgccagacgtaaagcccgtctgtttccgagacggatagcccatccgagaggtctgatgggcaaatagccatagccttggcttgcaactttgaaagggctgatctatacgtgtttgcaatgatcggatacagtagcctcctcgtcccctccgacgggccatcttcaggaacatactcgtcgaccgaggtgcaaagagaagccataagcggccgctgctcctgtatttccgtcggcgtgccaagatgcgacgctgacccaacctcgaccggatcactgggactgttcatcagcccgctgtaagccgcgtgggccgcccggatgagggagatccactgcgactgggcgggcagcaggatctccggcagcgttacaccgcatagcttcgccgtcctcgcgagatggacccggacggcgtggtccgcggagcagtacagcaccatcaagggcgcgttggcgaggacgtactcgtactgggcggggctctgcatggtgacctggatctgtcggagggacgccttgtggtggtcgcctgcgaactcgaggagctcgcagatgtcagcgagggtcttttggtgcccgatgtcacccttgaccaggccgtggcatttgctgacggcggatagtgctaggagggaggacatgacgggtttgctttggagtgcaagattcgggatgccgatttgcagggcatagcggtcgaccgagtcgattgggattatgcggctggtgtgagttaggtaatgacttaagagggccaattcggttgcatcgaggatttgtggtgatccgaacagttcggctcttggttgtatgtctacgtatgcgggagagggagacacggagacgttcgacactgaacgctggctgctgatatctgagcatgtatcggttgggatagtgaggtgtgccagtcgcggatcgatgttgtcaatgctgcttcgcttctttcttgttgagaggcttcgtccttgagaatcatccttggcgtactcgcaagtgtaaccccgaatgtcacatctagagcatcgcggtttggcctcatcacactatacacaaccactgttagtcattatccggtccggggtatgacatcgcgataggttacctttttcctctgttttttacacctgacacacccatttctcgatttctcatgcgctctccgcggcttgaaggccggagtgtgcacatcgggagagtgggcgtcttggggactactgtggagagtcattgtttcgtgaacccgcgtttgtgtcgtgaagatcatgcacatcaagatcgccaggggacgaatctgcagcagcatcggtatattttagctcaaaaggcatttgataagcagccctttagatttgtattagtgacgcaatgccgcttcagccccaagctaagtgccggctcagcccccaaccgggccagaagtcgggcaatgctgagcaagctgacaccactacgcttttctctttccagtaatagggttgacttcaacgtgccacgggtattgaataggctattcatttaaggatgagataatatgggcccctgcttcatatggctcaccggcggcactgtgagcttcaagtggccacggcatgtcagacttctaaatcgaagacgcctgatttgggccatctccctcccgagactcccgtgcggcatccacctgcagccctcacgcctcatttaaatgagccaaagtcccgaaattgatgacattgttccatgctttcatcctctcttctgccgctactttgaccaaatggcggctaaaaaagttccagaagctcaagtaggactagctcaccgctgggcccactccagataccctatacccgagcacagcccagatcagatcaatgagattacatatacttgagttcaatgttgactgggctattaaatgctaattgtatttgtaataaacccaaatctatgctaggtaagttatgaaaaggctgcctgcctaatcacataaagtacgtggttaaatagacttagttcatgcgcagccctactgcgtcgatcgcgaatcctctaagcgggggttcaatatcaatcgcaacaatggtttcctttgagtggccatcataaacacagcccccttacaatacccggctgaggtgagctttcggaggcagccaacaggctaggttcggggtcatcgggttcattgcatcaaacacgtcatgtcaaagtggtcatgacaagagaccaagcatttcgtagcttactgaaccaaactctcaagtgaatgggtggtccctagtttcatcgaagctcgctcttttgactaagtgatcctgcctgttgttgaagttgacgtttactgagcaatgttggtggatcaaggccatccagcggtgttggattgagcaccatgtccattacttgcgaatgttacaagaggttcgtcctgacggcaagtgagtcatcagtatgaaggttggtttccagacttttccttccgcatggctgcagccttaggccaacgaagcttaattttgtctttcgtatttattgtcttgagatgtcgcgtctggcatctcctattgctgtttcaaactttatactcgaactctcttccgttacaagcggtagcaggctttgaatataatataaggccacgcaatcgactataaattatactgcaatagaagacaatgtcagactaatggtcgaaacaaaaggctaacactaacatataaccctagcccagaagtggtcatgtccaggatgatgaataatgatctcccttagttgtagacatgagtacacgaaactaattcaggctttaaaacgcagcacggccacggagcctgatgcgcttccaaagtgcaacagtatctcccctaacacttgccgagactcctcggtattgcggtggtaaccagagtagtttttgagaatcccgagtaatccatgtgccatcggcgctgaagccgtatcccacggacttgacatatcctttctcgtcaatggtccaagagccaagatttgtatgaaaacagttctcgtccaatgcgtcaaaggacacactggtgattaagccaccaatacgcctctgttgatgggtcggggtctctaggtcgtagtttacaccaatacgcatctcttgatgagtaagggtctctaggtcgtatgtgtttatggatgatggttcgcagaagacaagccacctcctattgatggctaatttcccctcaataacatcgtacggccccctcccccctttccccgcaaagtgaaattctgtgagcctctgaggtggcagtgtatctaccttccaagcgtaaagtcctcggtctgagagcatggcgaagagtgcagaatttcgagacagagcgatttctgaagaatcttctttcctatcgatttcaacactccacagctcttcccccgttgaaatcttgtaagcgcgagccaaaattcttgaagccaagaccaatattcgaccatcggccgagaatgtctgagtcgagaccagaccgtcaaacatgaatgtccgagtggggagcgagaaccgaaaatgttgcaacatttcctctgtttccagatccactaagcgggttgcaccatctttgaatagagaaataagccggccgtcaggcgagaggccacccataagttgatagccgtcattctttctgtcgtcattgaagctgaaaacctgggtaggctccagacttgtcatatcccatatcgtcgttgaatatgtatatttgtcgctctcgggtttcaggaggagccagcgaccatcaggagagaattgaagcagagcaatatggctttccagaaggaactgtgtcgtcaaggtccggacgcatgcaaagctcgcaatatcccatattttgactgtttcatccgccgcagcagaggccagccatttgccgtcaggggagaactcgactgccctaacttgaccggagtgacttcgagaatcttcttcgatggagccatcgtgcctgagcgcgttacgcccagcttgttggggcgtttgcgacatttcgacaaccgttgtgatgtcccacaaacgtatggtttcgtcctctgaggccgaggtaactatgcatctttctggagaaaactacagcgatgtccccggttttctatggccaaggaggctttggacacagtttccagtctgatcccatattttgacaacgccactcgacaaagcggaggcaagtagcagtccaagcgacgccatggcacgtactataccagtctcactcagcaacctttgaaagtgcccatccttctctgtgtcccatatgagaatctgagaatatcttgccgtggccagtttcgatccgggtagaaataccgcccctacagaactagaactggcagagaagaggtatctgccgatcactaggtcccagaccgttgtgtattttgccgtaacagccaattgtttcccatccgccgaatacgcaattgaagacgcggctccggtatcgccaaccagtctatgtacaagagcacctgtcgccagatcccatattaggacaaaacctatccacaagccggcagcaatttgccttccgtcaggcgaaaaagcaacagagcaaacttgaaagtccttttcttctctgaattttgtatcggttagagaaacttgtgtatcggtcagagacaaatctgaatttcgtagttcaattacgtcctttgaagagcctgctgtgcgagcgaccgccacatgtcgcccgtcagaggagatagcaacactccatatcttgtcgcttgttgagaccgaatgcttgtaactatttgagctagaatcccataacaggaggtcaaagtgatttctacgaccatggccgtaaacgagacgctgcccatccgctgagaggtcgagtgaccgaagatttttgacttcaatttggagtcgaaatgcagagcccccatttacccgacgggtcttgcgatgagctttgcctcaaagtgacccaggagtgtatgctgctctcgtgtaatttcttgatcaggcttgatgcaggggcgaataatagggctgagccatacaactggaacggctcgacatacagtacctctctgaaagtgagccaaagcctatgtaggtcttcagataggtttttcagctcatcggaaatctgcaatcccattagctggtattggcgtatcaattcgtagtacctaccgcaatggatccaagcttttgtatcgcgctgataccctctgtggcgtacccataaaagcaaagagcttccacccagtaaaagaccttggttttgagaaatgtgcaggcgagatcatcatcttgggcctgcctctcgtggcttgctagcttcaaatgatcaacccagtggaggcaacaatacttgatagtatgaaatggactgttttcgttcaggatgatctcgtcgataagcttcccatgtgacgaaacctcgtacatattgcgcttgaggatctgcatggctgtcattgattgcctgaatatctgcaggtggtgactctggacggtagattggaaaactcgaccgtcaggtccgacgagaaagtcttgggcggattgatgcacaaaatgaacatgattgtcccgagcggagaggaatgatccacaatctccaataaactcctctatttgctcattactgaaatgttcgagttcgtggatcaaggcagggagttctctgaatgatagcgggctggccgcaataggcgccgtggcaagaagctgtttacagagagaagaatttatcgatgagagcacttgctcaagcattcgtgcgtacaacttctccagacccgctgggattgactttaataactgcatcgtgttccaagacctgacgtgagacttggaaagctctgcgcagaccaaagctacccacaggaacgtgtcattggctttgcggcgaaggaagtcgagcacgtccgcttttgtggttggatcataacgcttgaatttggctagctgcgataccttatggtcaataaacaggttcactgcatgcgagacagagtcttggttgagttctagcggaactttgaccttttcagccaactggaactgttcctcaatcataggccagttacggctggacacaatccattttgccttaaaaggattggaaaaactgatgattatgcgaatcaaatccggaattgtatcctcggtgcactcatcgagggcatcgattacgaaagtgagggcagcgtaaccgggatcttgcaggatatctgccatgatctcttccagcgtaaataaagccgcagagtcttcaaatgaatccttaccctccgtatcatatttctttcgaacatgagagaccagatgaggccgggatgtgcataagcgccatatgagggtgcgaagcactgcagtagcgcatctcaacgagttgctctgagtggcttcgcagaaaaagtatgagacggatgtagagttttcatgttctaggtcattaataattccacacaaaagcatggttttccccttgcccgggtcccctttcacccagagcaatctgttgttgctatcgtttctgaacctctcatattccggatgcccaagaatccactcatatgctccctttagaaggccacctttggcgttttcaatcgtctttttctgggtcgagggattgatgattctcaagtcgaccagacatttcttgtcggtttcgtcttggtggtattgttgaaaggctttcgtttggactttcacagcagtctctacggcttccagcttcgtatcccagcctttcattttttcgacaaagcctatccagagttgctccggtggacactgctcaggcaaagtagaaagcatcgatgtaagaagctccgtggagaccttactacctggctcctgtttccgaattgaagctaactgagtctttaccgtgtccggcatcatgctgagcaatggggccatattttctaattggccatcattgccatcatttgctgcgctcctcattgcgctcataaggccctggtcaggctgttcaatatttccaagcttgtcttgggcatataataggcagattgaataacacagcgacaggccgtgggaaaggtcaataaccatttcatcccgccgagagatgtcccccgcttgctgtttatagagcaggggatgcgccagcttgttgtacaagctttcgggcagaactcgtcagttgtacctcgaaaacaacattgcggtaagcgccaaggatgccctgggttccatttttgacggagatgtggtggttgtagctctgatatgccccgaaccaggcatcccattcctttccaacggggcgttccctggtgaagatgttggggctcttgccttgccagaatgcttcttctattagtcggtttgccggctcaagctgcgagggatagtcgaccacgatgcgaatgcccgccaggtcatgcatgtcgtggaacatttcctccacgctcctgtatgcgcccaactggttcgcaatgcggtgctgcagccggcgatcgagagtcttgtcaatcgactgcgcggccttgactctcccatcgactttggctgatatattcctctctctaacgagattttcgcagtgagcgatgaggttgctcaccatgagatcgtagtcaccctccaatctcggccagacgtcacgcaggaacgcagatttgagaggtatgccgcgtgcagcagagagcactttgttgattttcgaatgtagcccctttcgtcggacgttgccgcttggcggtcgaatcacttgagccatggcgacaactgcacatggtgcatgtgccgaatattccagtctgcgatgtgggagtgccaaatattgccctcaggcgatagagtacgcctggatgactgtgctgctgaccacaattgggtcgcatgcaaggcaactttgagaccaatggtgcgcagatccccgcgggcatcttccaagccaactattcgtccagttccaagcggcatacccgccactagggttgatgccaccgttgcaatattgaatcacaccctcacctgccttgaaatcaaagtctcatattgtgttcttttcattcaggcttgttatttgtgagtactagagagcgatcgaatcgtcttgtgtcgactatatcaagtacggatttaagcttactccctgtgtttcacccctctcacaacaggtgtgaatatgttagtcactccaaaagcagaattgcttcactgaaatacggcaattcagtgttcaaaccgcttgctctcgataaagaggacgtgggcgaatagatcaacagcaagttctttcgaatgagaggtttatgagttaaacatcagccaaaatctcatttgtgttctaggaaaggctcaagagatagattctatcttctttacaatcatatttccgtgaatgtcggaaaagatgggccctcacgaggccagtctactccgtgatttgttgtccgagatcttcgagattgagccaccaagaaaggcctacggcaagagagcttgctgatcatccttggtttaccctcgacaatcagtctcccctcggcgagcgttgattgcgacgtgtgaacgtagaaagatactctgcttgtctcttaccgggatatctcgcatccccccccgaagacacaagagcggtgattggataaggtacgttagtaaccatacatcatcgtgaaccaaccatctggacttttgtcacatatccaatcgttcattgaatcattctcctcgtatgcggactgaaagaagtctgatcggccacatgataaaccttctgggcgaagagcaccgtcaatcaaacccgggaaagccccgtagtaagcatccttccgagagccttgataaggagcgctgacaacttgtacgaccgaagtaagagtatctagagtgtcctcggggtaatagctggatcgctttaccgcgggatcatccgtgagcttgttgagctcgattggtcttcggctccacaactcctcatcctcaaaccaaggctcatactgtaggctcggttgtctgttagaatgctcatgatcagatgcgagtgccaaggtcgttttaacttcgtcctcaacttggctaccatccttcataccagccccaagtaacatccgtgcgaccgcttcgtgttcgtttttaatagcataccataaaggaatccttccccgagaatctctggtttttacgttggcgccgtgaaatagcaggagcttaacaatttcttggtgtccggattcagctgctaatgatagtgctgtccgtgaatctccgtcttttagttcagtatacgccccctttttgagtaggagcttcactaccttggagtgaccttgctgcgtagctaacaaaagaggtctcctgtagcggtaatgaatatagatgatagtggggttagtgtcaataagaagcttggctaggctcaagtagcccctctccgcggccaagcagagcgtagacaggcgaaagtaaatatctttcgcatgacctcgttctaccagtatctccgcaatactcatatggcccgtatatgttgctagccagagcggtgataaactctcactatcccctatgcacgagttggccttatggtcaagcagcaaggcaacagtccgttcatggccatttcttgacgcccaccataaagcagtccttccgcgccagtcaacgagatcaacagatccgacttcgacaagcttgggtattacttcgtgaatcccaaaataagctgctaaatgaagacctggcatatcggtagcattgtattgagggccaaactctctccaagactgtatctccgtggcttccactacctgaaaagctgatgatgtctttttaatcgacttgagaaaattaacaacttggccaatagaataagagttcttgtaggtgtactttccccaatagttcgctgcgtaaacacaaagagggtaattcttaatccgggtctcgaaggcgattcttgttccgcatgggccgtcctcgaacgccttgaaagagaggtaggtaatgcatgtgtcgattaaatttgaattttcgtcagggaaccattgcatgtatgtcctttgaaagtattcttgggtagtcttgtgtatgagcccgactacatttcggtgctcctccacagtaactagcccggcgcaggcggataggatgtcttcgatatccgagagatcctcctgggtgatatcctggtcaccatgtcgtactgatacggcgtgctgcaactcacgagggcttaagtctctttttgcaaatacaatccaagataatatccgcctcgcgaattgaactgaactctggccctgagagttaattctggtcattgcatcttcgtatgcgcgatcgtaagcctctgatccagatggaagactctctagcgcctgtcttacgtctctgggtagcttcttgtccaagagggagtccagctggagcttggcaagtaaaaagcttctataggattagttaaactcttccaaaaaggcaacccattacttacaccccatttacagattttataacaccttcagcaacacttttttggaaatcaggccgttgcaaaatctttgactctccatggacaatacgctcttggagatatcgacgtagatccatgtcgttagcgtgaatttccaaagtacggcttccttccatcctttgtttaatgactgggtaatttcttgaggtcactaaaagattcactgaggtctggctctgaagtgccaagagcgctgatatgaattttgaccgcccaccgtcagtgatcgggtattcatcaagggcatcaataacaatgaaagttcgggaaaacttctttgagacacaggaaagagtttccaagatttcctgcaatgttgcccgcgttttttcagtcttgtgccgattataaagctcgatgacaggcgttggtaggcaagacgaccttgaggtaagttgttttagcagagatgccatatgatcagcaggcttttgttctcgtggttgcagatagctgcaataaatgtatgcaagcccaatattcttatcatccattgaccgaagtgaaagattgttaatgattatagacgcaagtatcgttttgcctactccatggtttcctgggcagtaaagcgtttgaccagcggtactcagccaggtttgatattcctccgatttcaaaaaccacagacctgttccagggcagctgcgttcaaagaagtcagactgttgggcattatattcgagaggcgtgatccaattgaggacttgcagtcggttttgtgattgattgtgcttattgatttgatccgtcgctccggacacggatgaaacttgctccttgatttgattcagagctgcatttttttgttagcatgagaatactacaggtttctcatagtctttggtatatgtatgaagacaatacttgtaacgtacttttatcaagcgtttcggcccaggatggcatcaatgtgaccctcgtaggtttgactacatgcagcaatgctcgagcgtaggctgctgccgtgagcgccgcgtaagcatgccattcatcgttcttgtgagaatccgagtagtcgcagatgcctctgatcactagacatgggaaatggttcatcaagccggcagcctccatttcgaaacacattattttcaaattgggtcacctgcatacttgtctctcacagctgcgttcttcatcaccgtgttgccagaggcaattgttccgtaatgaacagtgacttgacgaatattaatccgagctctccggttaatgagtgcagctggatcacagtttgagcagtctgctcctccacaatgaagatattcggaacggtacaagctgtcactctgaggcattccgaaggtgggcatgtcttgcattcgaacaaggctctcagcgatcatgtcaggctttcttgggtcattatggcgtcgttgtagctcggatactgcaccgaggagcaatgatggaggagaattttggtgcccagagtgctgaaatcggccgacttccaagctttttcctagatcatattgatacacgcccccattcgctcctcgaggaacgctgactacgacatcgccaaggcggatatcgtgctctggactgggtgcgccgcccccgatgccgaccatcaaggcgaaccttaaatgcgaaaacgacctcaccatatcctttgacacatttgtagcttggctgaggccatatcttggtaaacacccaatgacaatattatgcagcccaatgcggccgtagacgtaggtattgtcgtcattcatcccgtttatttcagggccgtcaaactcctcatcaagcatacggcatccagcctcgtattcttcttgtaaagcacatatccacccaatagagtaatcctcaatattgggctccatagtcgatcgcctactaccgtgatcagcgttgaacacatctgacgtccatacactcacatggtattcttacgtgccatcgatatgcatttggctgaaattcattggaagtgagttgaatggaaatggtctttcatcggcaaacttggttttataccgcctgaataaaagtgcaactgcctagcttacattgtggcgaagcagagtcagccgtgatatgcctaccatcttcgatgattagtccatgcgtcatccgacatgcctcattacgacagtgtgcatattgtggtacgggctaggcagatttacagatcccaatcaatctgtgaggctatcaatggtgcaacagtgatgtataaaagagcaatggatgacaacaccgaggggagattccagagtagaggtaagataataccgaaatatccttgtgtaatgacttgatagctattgatatatttaattaataagagtaaatgctatttatagcaagaattatttaaaatagatccttacatgataaaagcaatttttaagtgctaataatttatatttatattctaaagctcccttcctgaaataaactactatagatactcctttataacaaatatagaagagttcttataggttaatcaactatattatttcactttctatcttataactcctcagggtcataaaataaaccaagaaatcgtaactctccgacttttgtcactcttaaggttcctttagtcaacgagagcaaaatatttttgatctcttgaatcagggcttaaatattaatagataattttaatatatttattttgaaaagtataataatatatacaattaaaagataatattttaaagggaagaatatgcttaaatacttagcgagtagcatgtgtaatctttcaacttgggctattattaaaacgccgcattggaattccggtgtatagggtaactttgttcttgggtttctaagtcaacatggcacccatgtagccaagttctagctgcctagatagacgagagagccaagaacaagattacgctcacacgccaggagtcacaaaacgacggaacagcaaaaaaaagtaaagactctactggcggcttggtagcaaaggaaatttcaaatactcagcggtatcagaaagactgatttcgcagaagaaatatgaaatttgaggtggataagacacgacgctaccagcggcactgggagccttcgccctgaatgaaagcaacacagggatggtatgtgatgaattcattcttctgccagcggggtgctaaacgcaaagagagcggtgagcgacgctcagacataaacactatgcaggtgacgttgaatactgcatgctcctcttaaaaggacgtagtgcctttcactctgcatcatgccagcacaccctccgagctctccggcgtggccatcgtgatccgttccgtcaggccgtttccctgtctggaaagttgcatgaccatattgtggaaggtagcgaatgaaatgaagcgcaccaataccgacatttctccgggtgcatggtaagttacgtgacaacaaaaagcccctggttatcttcaggccccgttcgccatttcagcaacatcgatctagtccgtcagttacgccaagctcatcgtagtagtcgacgttggtcggcaatgcctttcctctagagttctttgtcgagagaagtaatatagtttggaatggcattgtagagtggtgcaacaggtacaggctggaggagaccatgccccctcctcgtgattctcagggggcgtgttgtctcattaacccaatcaggcggtgggcgcttaggatgccctgctggaagaaagagagactttaggctacgcgtaaaccctgcaaatcctacaaagctgtaaggtcacttttcgtacccaagggttgctatgcgctgatcttacctaagaatgaattggtctgctaccggagatttccaggttctttttctcgtgttggctgaaagctcagtctcacatgtttgtggcccaagagattgatcaatacagagaggtggacatcatccccactcagcctggattcagcctggatttaccctcggctagccgttggtcgtcgtcaaccattgttcaatctgcattcaatagttccgtggcggttgatgggggctcgtaaaccctcaagctgaaggcactgctggggtctgccagctacccaagtagaagttgagcggaggcggcccagcatttcgctgaggtgatgcgtccctttcgagtgaggctgtgcaggccttgctgaaacagaaaaaggaaacaccggctaaatgagcgtttgtcaggagttttgtataacagattctctctcgtgcagagccggtccccttggggcgtcatggtaaacaaatgctatggtggccgttggtgaaaagatggctgccaccagcttcgcgcctgtggtcagctgctcgcaactcttcactaatttgcagcagcgatttccctcctttccccctatttgctcaccagcgaatcatgcaccttggccactggccatggctgctgcgggagggtgtcatgaagctactcggtctgttcaatcagcgggctttgtgtactcccaagtggacctggcacgatgcacctgacacgtcaactattcaggtatttggaagaatggagtctcagatatgtgctgtttcccaatgcctcgagctagacatgtgtcttgtcagccagtgcatcgtcgattttctccttgaaacgtggtgttgctattccaggcttcttttgtttgtttcactccgacggtacgacagcgacaagaaacgaacgaatcgaaacgaaataaaacgggcggacgaacgggcgatcggatggagggaagaatggacgaacgaccgaccgaccgaacgaacgaaagacccaagaatacaatgttgttacaatcgacagatgagaagatcaaccggcagtacacaggacacgtacacggagaccccatgcagttcaacgccaaagtaagcggagtggctgctgcacgtagagaatagcgatagccagttctagaaaccgagtgaataggaaggtgggagatttgcgggacttgaaggatgttgttaagaggtctccaatgttatgagctggtgttcggcattgggcgtcgtggtggactggtgagaatgcctttctagtgaaagggagggttcgtagagaaagacggtgaggtagtttggtctggcatagcacagacgatggaaaccaggtgggcaggttcggaggaatgacaaggctattttcgagtcccagtagcgcctgtcattccatgtggcagctcatctgtagactactagacttagcttcgggcatttctccgttttgtaggtggatagcaccatttgtcttttacgtagattgagggagaagtaactcggtgcccactcttctcgctgtagttctcagcagtaggtggtggagagcttggggagttgaagacgcagatgacttgaaacattatgagtgattacgaggggatgagagaagggcgagacggacgaggggtagcatatgccaactgagcctgatctgatcaggcatctcagccagtcccgagactccggctagcccttggtgcattgcatgcctgcccctcatctagatcacgctcctaccaccggttcgacctggcccaccaactgatctccgttcccgtcccatgttcctacattagttcagcgggctgagtcagtgttccaaggatctttcaacatcagtcaggatcttggtttagtgacaacaacaacttgatcatggaccgcgacaccacgatggctgaagcacctatggactcattctatttaatatactttgactggattcaagtcaaatgtccgatatcgtttgtttcatctcctgaaagagaattcttgggctgcagaaaccgatgggtcacgcaggttcactcacgagaaacagacctgtggtaatttaatacactacaagcagtatatgattttgatgctagtatgattggaaacattttcgcacgatcgaaatgataagagcgtattttatttcgcattaacaggcgatgccaggtgatgaataagacatggagttatctaatccgtccgtttggtgacgggcaacgaacggatgcagctacagcaataagccgggaaagtgatggcggttacatgattactaattgaagaaatagaattgcccatttagtggtcgcaatctgcgagagcttggcacgttgtgtgaagctgccggttggaatagtcatggtgaaaagcaggggatgattggcaccgtgttttacgtagcataacggtcgcgattaggtacctatattcaattaagggggggacaatacgggtgatcggccatgcgttaatccggcgggaaggtcatttccgcttctgggattgttgggatagcaagggatgataatcaaaatggctggatcatgggtttgctcgggccgaagcggcgctgggtcctttccgcttcatttcaagtcagccttgctgaattcaagccagcagggggggagaggggttaggcataatagggacgtgatttcagttcatgtacggtgctatagacgagactgctgcccaggtaatgcagtgagaaagaccccgctgacgtaggtgaatgatgccatggttcccccctgtatctaaccatcctcctccgtgggcgattctcctaccgttagccatggcccgccagtcggaaagactccagagcttacggcgccctctacgcgttcccttcccttccctttggattgaaggtgtagttaacaactgcagctccgacagtaggcgatatagctgcggccgccaaggtgggcatgtatctttagcaggtatgtgtggctgtgagctccccaccggaaggggtctgtcacacatgcatgagttcggaggcaagtgggttgaaaacaggatgagacactaaactactgctggagtgtactctcacccttataccaggtctttacattgatatttgtcaaccaactacggattttctaggctcaaaaaaagcataaaagttttaatcaaggctgagaattaccaataggctttttttttattaatgaatagtagtattactgcatctggtggccagaaaggagcctgtctaattcggtgtctcatccattttccaacccacttgggaggcccaagtcatgcccttcctggctctctaaacatctatctttgaactttgcaccatgcaaatagtcggcgagacaaccgggataagagctccatggctaagcgcgtgtgtaggctctcggggcttcccgatgttcgccaccagtcctttgcagttttctctttcctccgtaacatagccaaactcgctaatgtcgtcagacgacaaggttccccgtccactccacttcatgccaaggtcctgttcatgacttgttgcctctgttgacgagggagcgccactctcgttgcatgtgatctcttgcgcgaacttgttctctcttcagcatctttcaagtttccaaccgctaactggggcgcgaaggactcggtgtgcagggtctggccttgtttgcgggctgcctcggggacgagagcgagtccagcgatgatcacatcgcactgagtgcccgcagtctggcatatccaagctagcagggcaccccatgatggggaccatgccatctttggtcgcaagtcctcgcgagtcgagactgagaagcccaatcaacaccattgcctggcgaggaagcggctaagcatgccttcctactggtctgcatggctgagcagaaggtgtttcctccatgcctctacccttgtcaccaagccatgatctcgactgatgttggcattaattccgcccattcgaacctaaaactcgtctcgcccgcacgcgcggaaccagctcagaggaagtatgggctcggcttttgattccaggccgggcataaaaggcggagggcccatcacttgcccatctgatcctgagcatgcatccatcgtctcttgtccaaacacagagctccaactgttagactccgccgcccaccacgcattgatcttaaccacccaactcaactccctaggtaaccggccacccacaacttcgcgcgccatgtttcatccatccacgccgcccatcatgagcatctgccgcaagaaattgatggccagccctgatgttgaaaacgacccaggcacaaccattgtcccgaagtagctttcgcgtcctaagcgatccttgcagagccagagacgtccagtgggttccagtctgttgcagcccctcaccctcggagcctccgttaaccaatggcagaaggcatccagtgcaggctggagtagaccatcatcgctggaggctaatatcaaaggggattgcataccatacaaatagatcccatgtgctagcaccgtatgtggggatctgtgcgtttcccctgcccctctgtgcctggatcgagggaagcgggggaggggagagaggaaatcaatggaacgcggcactaccaagtagggctctctccggcttgtagatagagaaatcaatcccatgcttctccacacgctcaagaatattgtttccagcccaattgggttcatagtacgactaactacctgcatctgggtcaatcaaagagcaggtcggggcagccgaccgaatgcgtctggggtgtcccatattggtgagatcagtgtcgccttgctggtaatcggcggctctgtttcgtcgctaccatcgccggtaagaatcacccaactctgacggctgcgctgtctccaattgcgtgccggatcccccctccaagctgtgggaaatatgaccgaaatcgtggcggtgtacacgctgaatatgacaagtagggctgcatctgctcctggttcgtggcctaatggtaggcgagtgattgaccgaccgagagagtcgtcattccttgtgtcagcgggctgtgctgaagctgtgtaatatgttttttttctgcacttgggccacactccagcgtcggtcgtgagctgtggaaatcctcaagtgagaggagggccgacgtattaatatcgggctctgcccagccaaaacttcagagatcagaccgcatctcaaggcaaacaagcgggaattgaaagcacctcctcattcatggctcagcgagctcgaagctttgggctgttcagccttcgaggcgacagtgggaacagcgctagcccaacccccctgcgatcgctggcggccgctgaggcgggtcaaatggcagcggatacgcccagtgaaggtccgctaatgcaccccgctctggccctggccgcgcgctaacaggagcattagctccccccacagattcgacgaatgccgacttggactcgaagtcgagtaaggatccgttcctgattgcatcctgagctgaacaggcccatctaatgcatcgctagagtacattggcctgctccgtgtgagcaagctccaggcccaagacccaaactaccacggcgtgagggccttctccgacgtcttcgccttcacccaggcgtactttgagcatgggctggaccgggactggggcatggttcaaagcgccatcctctctggcgatgatgcgaccgtggagcgtctgatggaggagcaggtgatcaacaaggtcttctctaccagtaagtctctcatcggtatcaaccttgatcaagcttgccgtgctgtaaaacctgatcgtcccgtagtgaagttggcccagctaaggcatttcatgactggtctcaacaagatgtccagccgtgatctcaaggtcttcctcaactacattagcttagaaggcaaaagcgaggttcagtatccttggaccgcgaggcagtggagggcactcaggaacccgcgcctgtttgaggactgggcgaggtccatcatcatgaatgacaaggtcaagattggttggttcttggtaggtagtcagtaatattcttgcctcctgaagcggactgacgtggctagggctttcttgtcaagttcaccgacattaacattgtcggcatgcgcaaaaccgaagggtatcccggccggcttatcaactttctctcgacgggggcaagtctggtcgcgagcatcttctttggggcgccattcgtggtcctggcttccgaagcttttgcgcgatgggtgaatatcgtcgtcattgtcgtctgggtgctcctgtttctcgtctttctgatctggtggggcgttgactcgtcgcacatgttcttgtacgtgttggcttacacgaccatgttggcaaacgtcaacgtcggaggcgactaatcgaggtcgggcggcggcggatacgggaatggctcgaggaccgtcggcttttcgaaagggctgactgagtggttgggaagcagtcgtgtaacaagttggttgttagctattgaaattcgagaatgttcaagccttaagtcgctcccaagggctgactgacccattggagccttatgctcgaggcgacttgggggacccagtcttgagtttcatggatgtctgggggagcacaaggtattaagctgcattctgtcaatctcgtaagccatgccaatttagccatccgcagccccttgactgcttgcctaaaccaagaccattgataggtaccagccggcccaatttacagaaataaccctgtgggtcactttatacctatcaggcccctattaagactaggaaatatattacaaataaataaacggttttaataattataaaaattcctctctgttagatagcctcactggtaaagttatccaatgtttagaattattgnaaaaaaaaaaaaaaaaaaaaaaaaacctgtgtattagcttttagaaagatatttatataattaactgtgattgtttctagagcttaacttgtagcaggttttattggttaaagttggtcaaatcagaaagtgggtggctaaatatagaaagccgtccctttgatttcctggtgtggacggagagaaaactaaactgatttaatctatgggaggtatgggtgggctagacttgtggttgttaacgccgatactagtcaacaccttcgtcacaagtgaaatgtgtatataccatttatcctgggagatcagcgacttgatatacttaatggggtccctgcctgcataagtcatgttttcttttggcaagccgatatctttgttggtggatggaggatcagctgccgttgaccagaaatccctcgaataatcagattccgattgatacacgaacagatcccatggtttgaagcctgggtgtcgccaggccgcttggtctttcccccggcccggcgtatggcattaatgtgcgattgcatggcatggagccctatctcgatgttctgggttccagctggacattcatttccgttggtagcaacacaatagcagcatggtctagtggtgtgcgagggacattaactcttggctgatcaatggtctctcagcatgtgattgggcgttggatcacgatttgtgaccaatacactgaatcctgcttgagctgactcttgataatgcacaagacatctcacaattgacccaacctattcccaatctagataccagctgaaaagcccaactcgtaacattggctgcccgagcaccccgcacaatcatgcaccgcccccttccttgacttaggaccgtcatgattcatcagactccttccaatataccttttggatacgacgtcggtgaagtcttgcgtctaaggcgttgtaatcgccatgtcagatgtattagtggatgagtcgcccctgtcgccgcaggcctacacggtcgggttgatcaccgccttacctgtcgagtacgctgccgttgtggaaatgctggacgagagacatcagtcaccgctaatacaaggagaggttaacgcgcaatataccagcggccgaatccacagtcacaatgtggtaattgcttgcctcccggctggtgagcccggccttacctctgccaccaccgtcgctactgaaatgactagccattttccgaatattaaatatcgtctcctcgtcggtatcgggggtggaatcccaagcgatatcgatatcagactgggagatgtcgtcgtaagccaacccagccatggacacgccggggtggtacaattcgaccttgggaagcgtctgccgaatggacgatttcagcaaaccagccatctcaataagccaccgaggcctttgctgcatgctttgtccgaggttcaaagaaaacatatgttggatgagggctcattttcggaatacttatcgcagcttggggaaaggagggccaagttcagacgtgaaaaggccggaccggactgccttttcccacctgagtatcctcacaagagaggcaacaactgtgaccgatgttctaagaaaatgctcgtagagagggaacctcggtcggaagaggatctggtacaagtccactacggcacgattgcgtcgtcaaactctctgattagagatggagtcgaacgggataaaatctacgaagatcttggcggcaacatcctctgtttcgagatggaagctgccggactgatgaacaatttcccttgcctcgtgatccgtggaatctgcgattatgcagactcacacaagaacaagaggtggcagccttttgcagcagctacggcagcagcatatgcaaaggagctgctgcaagtgatttcatctaagaaagaagcagaatccgatgagacccaaggcaagactttcgtgaaattttttaattttcgtcaccacactgttttgtcgagtttcgatgctaatactttttggtagctccatggattttaccattcaaccgaaaccctcattttactggccgctacaagctgctacaaagactccattactgtctcaatgaccctcagaatcatccagaaattgctatctacgggattggaggcaccgggaaaagtgctgccgctgtcgagttcgcctatcaggcccgcaagagcaatcccatcctggcggttttctgggtttcttcatttacgaaggagcgtttcctagaatcttatcgcgagattgcgctacaggtcaaaatttcaaaaacagacgattccgattccgatgttctcaagcgccttcgaaagaagttaagcgaacaatccatgggtagatggctcatgatagtcgacaatgtggacgacagctctgtcctctttgatgataatgacggcagtggtcggttatatgattatatcccccatagtgcacaagggactatcctcttcacaactcgaactcgcaagatcgctatcgatgtggctcctcatgatgcttggtcacttggtgagatggattgttgcgagggaaaacaactgttgcggaaactcttcggacatgaacaaaacttagcagacgatactctggacaaattcctcgagatggtcatatcacatccactcgctattattcaggctatcgcgttcatcagaaagaacggcatctctctagaacgctatatggaattgtttgaaaagagccgcagctcgcaggctgagctgttgcgggaggatttcaatgaccccaacagagacagggaatcgagaaatgccgttttccttacttggaagatttcctttatgcggatagaagaagaggacaaggttgcagctttttaccttggcttcctggcttgcattgcaccgcaaaacatcccgcgagcgattttcccgtccgctcaatcagacatcatcgcggagaaagcgcttggcacattgaaggcatattcatttttaagcaagcgaactgacggcgatatttacgacgtccatcccctgattccaggcatcgtgcaagaacatttagaagaaagtggcggatggaccgcaatcacagctattagcctcctctggttaagatgtttggttccggaagggggctatgagaagttgaaagaatacccggcatttcttccccatggaaaggcctttgcagacattccgcagttaaggagccacccggaggtactattattgcttcgcagcattggtcaatgttacaacactctcgggcaaggcgcaattgccattcaaatattcgaagacgctcttgaacgcttcaagcagcagtttgggccaaaaaacccgcaaactcttcataccatgcatctcttggggaaagcatttcaaacacacaagagttataaaggagcagcgcgtacattcgaagaactgttgatattagagaaagaagccattggtgatgaagatcctcggacactggttactcgatccacccttgcatcagtttaccagtttcaaggcagatggcacgaggctaaaagattatacctgcaggtcatggagtcaaggaagcgggtgctaggtgaggatcatcccgatgtccaaaatagtgaaatggatctagccttgctgtaccgggatcaagatcgatgggctgaagctgaaacactgttgttgcgggcccttggacgaacgtcgttaagccctaggaataatttcaacaatgtcattttcatcaagtctcagttggtattcatataccaatgcgaaggccgatggaaggaggcggaggaaattggatcacaactggtcactgattcgaagcagattcttggcgaagatcatcctgacaccttagaggttctcgccagcatgtcaggaatctaccaaggacaagatcggtggagcgaagcagaggaaatactgttacgggtaatcgagaccagaagaagaatccttggtgatgagcatcccgatgtcctggctgcgcagacaaatcttggcctggtatatcagaaccaaggggaactgcaaaaagccgaagacctacaagtcaaactgatcgctgttatgaaaagggtattcgaccatgacgaacttgatctcttggttgctcagggaaatctggcattcacatatcataaacaagaacggtgggcggatgcagagaagctactcctggagttggtaaaagtcatgagccaaacgctaggggacgagcattcagaaaccctgaaagtgaagatgaacctatcctttacatatcgcagcctgcagctgttggagaaagctgaggagttgcaagtggaggtagtgcgtaccagacggcgagtgcttggagacactcacccttgtactctcgaaagtatgcacagccttgctctgactttaatgcgctcatgccgtttcagtgaagcgatagagctcgtgggatcagcccgtcgcaattttagtgagggatatccttctggggaccagccctctatcttgattcgatgttgggacacggctgaggagtcactttggaaacaaactatcaatcaaggcttgtttacgtttttgtttgaataatgttatcaatattaaggatgtctctgttgcgttaagaatatagattcttctatttctgcaccttgtcatcgctataagctacttgatacaaatttactcaagcctgccaatcatccttaagaaacgtgatcgcgctcatcaggtcttcgattggcacataggtacttcaggaatagtatattcattcgccgtaaagcaaggactgccaaaacccgatgtttcaattggtttttggtattagcgacaaccgtatagaatataactcaatatctacaaatctatcatcatcagaatctccccatcctcatctgggggtgcggcctgcctaaatccaagtttatggtaaaagttataaggtgaatcctcaggctttacattcttggtagggttctcgctctttttcccctcaggtggcgttgaattcacccccagctgctttgctttaggatggtgttcccgtatatgtgcgatcgcaaactccacgcctcgtcggccgtagcccaagttctgataacggccgtcgatcatgaatctccagatgtagtatgcgccaccggcatcccaaattgccatcatgagcattccgacgagtgtgtcatccgcatagatggctctcacccaagcatcttcatcatagtgcgcctcgcagagtgaccacacgttgggtgcgaggttgccagtttggccatctttgaggcttagatttgctaccgcacgccagttgtcctcagtgatttcacgaaatgtgagatttgagtcctttgtagggctagcaatcttctctgactcgctcatggcgtctgggatatagaatggtaggtgaaaaatgccaatattgagcagtatgtgtgttaatgattacgtagaatatgggtagtgtggttgtacagattcttgtcacgattttggctccgtggagaaattataagttggcaatttatttgatctgtggatgactgtgtttgactcattgtgacgatcattttaggtggcgaacaccatctcatagggaacagggggcgtcttcaaccccagtcaatcaggtagtatcctcttaaaggatgacgcacttaagtcccaatccaaatttaggcgtcaagtcccactgctagtgagtgttgaaagtttcagttgtgagcactagaccgctcactagacctggcgggatgaccattcacaacgactttgggtcgtcttgccccgaggctccttgacgcttgggaatatctgtcgtctggatggtgaaagacaaagcgcacgattttcatagagattccttactccttagatgattaacagctacttcatgctcataatgttccgatacgaattctccgtgtttacttctcatttccattagaagttcaggcacaagttagctagagccactgaaggaacaaagttcggtcggtatgttcctacgacttaagttcgtggaggaaagccttgtttaaaatcacgcccgtgcaccgtgagctgtcccagaacatcagtgaaactgccatttctcataaaatgaagagtgaattggctcagttgtttccgcgtacatagatatttgtttcaatgtgtttgattcacctgaataatgaccctcaccatgtacattcacagccgctactaatgtataaataggcatcccgtgctgggcgtatcaactttctttctatttaaacgcgctgttgacctagtcttagagatcatttatcgtaacattcctcgagacagctctttttggtctcagcgcttaatcatctcatcattgaaacatcatctttagaccgtctattcttgagctatctttccgtagcatcttggctggttctcttccagctcctaagcttcattctactcatgaaggttccgggtgccgtggtgaggctgttcaagggaagtgacgcgagaccgagaaagcgtcctcccgcagccggaatatcaacaactcgccatcatggagaggaatccgagccacctatactgagaaggcctcgtccaagatcaagagtgaggagtcaggggggagatcgtcatgaagcccgaagagttgccaggccacgaaggcgatcggtcgcagcgaacatcgaacgaaggagacaaagtttcacggagtcaaattcggacggctggtcaagtgaaacgaatgatgatcatttgccgttagaagccaaaagtaaagatgaatcaaacagggaatggcatcagaaagtggaatctctgcgtcgccacaatgcattcttgacgcaagagagagatgctcaagaagccgcaatcgcgaaccaaaatagccagctgcaagcagcgcttgaggaagccgccgctgcaaaagagaaaattcaacacgaaagattcaagttgcaggctctggtgggagacgttgagaggttgaaacgagagtcgcaacattcagagactcatctgatgaggcacactcagcagcttgagtctgagcttgagcgttacaagatcgaaagtttgcaagcatcagaaatccagaagagtcttgaatcaaaagtgaaggacctcagagccgcaaaagacgctttatcaaaatgcatggatctccctgccgacgagttacgccaagaaaacattaggctagggcaggagcttcaggctagagatttgaaactcgatgaacagcaacaggaacttggaaaattccaaatggacaaagatcttacagaaaaggccctgaacgatctaaagaaagccaagctttcggctgaccaagagcaggctcagatgaaagaaaaaatggccgagttgcaagttagcacggccgagataagccgtcagaaaaacaccctgcaacataaacacgacactatggaagcaggaaaggcttcacttaatcaagagaatatcgaattgaaagcttgcgttgaagatctactaaatgccaaaaacagtctaaaccacaaatacgatactatgaaagcaggaaaggcttcagttgatcaagagaatatcaacctgaaagtttgcgttgaagatttacgaaatgccaagaataatctgcaacataagtacgacactatgaaagcaggaaaggcttcagttgatcaagagaatatcggattgaaggcttgcgttgaagagttacgaaatgtcaagaacagtctaaatcacgagaaaactcaaatggcgaaggagattgcaagtcatcgtctcgacaagagaaatctggaaaaggcttttgaaacactcgaaaatgacttaaaggctaaattcgaacaaacaaagaatgcccttgaagccgaaaagtcccatgccggacgtgaaaagacctctctaagcaacagactaacggcggcaaatgatgaaaatctcatgctcaaaaacagccttcaaacaatgaagtctcaccaggcacgcgttgatcatcaaggcaacgatttaagatctagactggaactcgcaaacaataagattcgttcactggagcatcaaaacagtgaatggtccagcaaaatcggatccctcaatgccagtcatattcaaaaggacagggccttcgcagcgttacaagcaaacaaagcgcagctggacagtgagaaagactctttgtctcaaaaactcaccacgcttaaccgcacacttgagtctgtgaaagctcaatcccaacaagccacagacgcgttacggagggaaatggaagaacggtgccgacaatcagaggccaaggtcagagaagccgcacatgctgttggggggcatcacaccccccgaacagtcatttttcagaagattctctcccaggcgcggacctctcgggatatttcagagattcccggggcaagtcgcttcatggaaatctgcacattgtcctcactgactaaccagtaccttgacctcccgttgagcactaagaatgctcacaagctagggaaaagtattcgaggcgatgagatggccattactgcttgcaatgtatgccagcttcccaagttggcacgcactaaccaagcccccaggttgagagttgatgagttagggcagaaaatgcagtgctgttctgtgaaaatatgtaaattatgcattctagacggagttgttcggtcactcctcaatgactactggtttgaattagagaagagtgtctgggtaaagtgcccatcagccaactgcgacgcatccttaaacattagaggaaggcaggaacttcaggccacacttcagaatctgggagatccaaacgtcgccaagcacatggcggcgtaagttactcaccttccccccacccatcaactggccatgactaacctactgctctagatacgatcgcatcaacaccttcagaaacgcactcaaacgcttagagctagacgaccagggtctaaaagtctcctcagctttgtactcacaacttgtatcaatgggtcgtatgcacaacattgcagatcttcccccaaatacagttctagccagggaagatatgccgagttttaaccctgccgaaatacaaaggataagtgtcgagcatcaaggtgttactgttgaaggggcatttcttactggattcacacgcagaaaaagaattcccaaagagtgtgcttactgtgtagagaaaatctacgacatagagacagatttcggcagaatatggaactgggttgaggattgctccggtttcaacggagactggatgtggcaggtgctaaagttcccattgaagcttgcaacagagtgcaatcatgatatcaatttctgtagcaaatgcctacagaggcatctcaaggttcagctcaaggaattcgggcgggcaaaatgtcaggatgtatcctgccctttcccccaatgccgccgtctagcatatcaagaggtcaagctatacgcaaaacctaagactttcaccacgtaagagatcccatacatcttacaagcaaaagctgctagacgctgacctatctcgaacagatacgataaatacctcaatctcaatgccttgagtcaatttccgaatttccgttggtgccttaaccctggcgaccctaacgaccgtgacaaacctgcctgcaatagtggtcagctatacgagggtatcagtccagataaccctcgtattacttgcagcgattgcaaattcgagatgtgctacaaacactcgataccatggcatcaaggtaaaacctgtgagcaatacgatagcgcacgagtgcatggcgatccagatattcagcaaacgcgagattggatagcccaaaatactaagaaatgcccccaatgtgggcaagatactgaaaagggagaagactgttttcacatgacgtgtaagtgattatacttcactttgctgatacgaatttgtatagcaccgtggccaatcaaacctactaacaaattgatataggtactttatgtcgccatgaatattgttgggaatgcctagcaccttggtctagaatatcgccacgcccaggagactatgttcaatcagctcaccatgagggctgccgcttccgcacaatgacggccgatccaactcaggtgtatgggacaaatctagacaatgcacgattgggacgcttttgagtgaatttgtgaatagtcgagcgtgggatacagtgaagtactaccaaacgaatcctggcgagccacgatggggagtgagcatcaagaaagggagcaaggagttgtcagcactatcaaacttgtcattgcaggtcttatagcagaattcaaaatctagaaaggatgcaacgcttgttttgttatttattcatcttatcataaggctctgtttctaggattcaaagggagtttcatatggcacttcggcctgaggggtgatcctggccaagtgccttcgctcgccattctcccagtccaccaaagcagtgtgctgagagactcggttgtcccagatgacaaccgtgtccgcctcccacttgacgcgtacgtgcaagtcaatgcttcgagcgatgtggtcgtacagaaacttgagcagtgcatcagactcttctcgcttcaagccaacgatatcgcgagtaactgtaagtgcggttagtttggttcaatgcacctagggagccttatttcgacttacattgctcgttcacaaagattgccttttcaccggtagcagggtgcgtccgaataaccggatgttcgctgacaacgggctcacgtctcttgatgctaccctttgcgacagaggcattcacttgctcaatgccagaatgggttgccttcagcccgtgaagacgttgctggaagagagggctcaagcgacggtatgccagcgcagtatcggcaaagactgtgtcaccaccgacatctggtccatcgagaagataaaggaacgtggtgccaggtggctgcttctcatatgtgatgtcagcgtgccaggcaacggagcttgtgcgggcctcgaagaaagctttgaagttttggtcgttggctccacgatggacgagatggacttcagggtgtccttccggtgcaccagaagttgggtgaatgtgatgacggccaaagtaaccaccgaactcgagagcatctttgatggatagatcggcaaagtcttggccgcggaaggcaacaaccttgcgctcagccacgaatcgagtgagctcgtcttttcctgcgtcggaaagggaactcaattgaacgccacggacttcggtgccagtgaatggcgtcaagtggttgactgtggtaccctcgggaagcaaattgcggtaggatgtatcagcatcctttccgtgctcgtaatgctcgaaaggttccagagcaggatacttgtcttccgggttccatgttggcaagtaatggggatactgatagccataagttagcaagatccggttgctgataacgcatcaaagtcacaaaccttggctccgggcgctccggtctttcccaactctacatcacggtcgatttgtgtggtgtcaatctccttgtgcttatccaggtggaggtggtaggtttggacgggggcagtgccacgggtagtggtggtggtctcggttgcagagggtgccatgatgagtgatagttatttattggtttgaggaacatgaccagactctgcctacggtcttgcgagaagcgtcttcttatttatacctcctatacttcacccgtggaccccgcaatcggattcatcagcatcatggggattgctcatctctaagtcggggtgcagtgcaatgcggatctcggagaaatgaatcgcaccacctccaatgacacaagagcccacactcttcggaacctcctgcgcttccgacagatcttggttggtgcgggatccgttgatgctatttgctggatcgatcacgcaattaagcgtcgatctgtgttggcagtagcgtcggtctaagttgtgagcacgccatcggtttcgccatctcaccccttatgcgagatgggaccatttgcccctgaccgctagtcagttcagccagtgagcaagcttgaacccgttccttatcagatcaacatcttcacgcccatgcaaagactgctatttaatggccaaatctgtccccgggcctgcaactagctcgaagttagtgcgatgtcggtgtcatgatagtcacctcctctgggtacggccgcacatccagtgtgctaaacttagaaggtgtatctccctcataccaaagggtagagcgtgttcgctctgagaccttttcttggtagtgtttcacttatcctaccaagattgggttaagaaggtctttctggaagtctctcatgtgcatttcattacatcttatttcatcattatgataaaaggctataaccttagacagattttccctagcatttaagggttgatttgtattttctgaccctgttatcaagttctaattatggttggtcgtgtaggacatggtcgtaatgtaaggtacctattctacctatactaagcaaagctctagggtaagtgatgatctcctacaacacttgcccgttttcttagaacagtccttaaaatatcacaccttggctctaacaccgttgaatgattgattgagattggcagaaatgtcttcaaccatgcaagtgagtatgtatgacttgactgcgcaggctcacattggaacatcctcctccgcacgttattgagagagacgggctttgaggtcgatgtttacatcgacacaacttgacccccggggagtagttcaagtaataggcagagctgcctaagaaacgccgaaattggaagcttgtcaaaacataattcggcctagcgctgtatcttgctgtcaatctcagtcgcaagagatcgtgccgtacatgccagacaatacgacgtgaaccaagaaaaaatctctacgcatgagagcttgtttgagctattggttaaattgggcactgattcgcaagcaaaggatcagtatcacacactctgcttcttagtgctgtggaagctaacgtggactcgataattgtacggaaatgttttatatttggccccagtaaatcactatcgtacagttttcacttctcttaccttgctaccatttctgaacccgccattcaatcatgcgtatgaaattactcagctgttaggatcaacagggataggctttttccagggcagctctcttgtgcatccaagcatactccgaggcttccatgattgcgagacttcattctagaaaattgagaggaattcatcattctgctcagaatttagtcgaaggcctgcttgaacaacgatctctctgactcagaggagaacattaatccagggatttagtagacccgatgagtaatcccgtagtgatggggtagctgtcgaacttggagatgtgaaatgtgcgaggatcggttttgaggcagttgtacaagatcgatcattggaaacgaagtcagcgccggtcagacaacctagtagcatgcctttaattcgcactctcaaaggtagggtaggacatataatttttttcgaacaaatgatggaaggcgttggaaagatcctacaatatttctagctatggctgttttgttagaatggatgactgaaccccgttaaggtcgacctctcagcgtcgagaacgactattgacataaccttgacgcgctatcttggcatctacacctttgctctaatgccatgccacggcatctattatcctttttaccgtattctgagaataggcagggaggaacagcgtcgctgaggcctatgttgataagttggctcacaaataacgagttgtgaaaagaacatctcaggtactcatgcgaagaatcaccatttgccggactgaatcatagagtagatctttctattaagagagactagacggcactgtcattgccgcgcgccaagatacaggcaacgatcccccgcctaccaagaccgatgttaatttgtctaaactctttgccacggccgggattaaacccatctccacccggccacaacatcggcgagcccaactgggaaagagtctgtcgttgcctgcatgggatcttatgctccacaattgaaaatattttcccttcatttcgccattcggctcgatgtcgggggtctcctgactctttattgctgacgggttctgtcactgtaacgcttgttgggaagacctggagactcttaccaacactgtcgtgccgttggaaaacagattccagttccgtccggacgccctgctgtgagaatgtcgtccgctcaccacggtgaagtgacctcggctcaaggcggcattggccatgccatcgccgttgcccccgcagagtcgggcaaccttggccgcgatgactacgacgagaagaagcagcaaacggaggccaatctttcagagttagagacaggcttggaagagtccttgtcctcagttgactcggatgaccctcccgatggcggcaccgctgcatggctcgtcgtcctcggggcgtggtgcgcctcgtttgttggctacggctggattaatagtatgtgccaattactattcaaataacataaactatcaactaacgcagtttctaggcatcggtacgtttcaggagtattacgaatctggtcctctaaaagaatactcatccagtcagatttcttggatcccgtcgcttcagattttcttcatgtccgccctcggtcctttgattgggtcagtttacgatagatatggaatcggtctcttgatccccattgggtcgttcctgcacgtatttggcctgatgatggcttcattgtcaaccaagtactatcagttcctcctctctcagggcatctgcagctccatcggtgtcgcctgcgtgttcctatccgccctgagcaccataagcggctggtttagcaaacgtcgcgggctcgcttttggcattctagcaaccggttcgagtgtcggcggcgtcatcttcccaattatggtgagcaacctcatccgcaaggttggatacggctgggctatgcgttcagcggcctttatcatcctcgctctgctcgtggttgcaaacttgaccctcaagatccgcaagcgccccgtcaaagccagcctttcgcgccaagccatggccgagcctttccgagagcctgcttttctgacgctccttcttgggctctttttggtcccatttggcctgtacatccccatcaactacatgcccgtagcggctattggtgccggtctggatcaacaaatggcaacgaatttggtggcgttttacaatgcagcaaggtgagtaactgtctgcactgttcttatattcgtcagctacaagctcttactaacgtttcgtttcctgtagtggagttggccgtcttgggtctggctacatatcggacaaggccggcaaattcaacatcttcatcatcgcttgctacgtctccggtatcctgattctggctctctggatcccagccagcggaggtatcggagtcattgtgttctccgtcttcttcggtttattttctggcgcctacatttccctgatgggggcgctcgttgcgcaaatctcgcccccggagcagattgggtacagaaacggcctcacattcttgatttcagcgattggcggattgaccacatcgcctattgccggggcgattcttgagagcccaacaggatggacggggatgaagatctttgctggtgttttactgttgtctggcaccacgggcattttattcgccagattcctcaagacgggcttcaaactgtccgctattttctaagcgaacctcataattattcctcgatgagctcatcagccttcgtcgacaatatgcaagggattaaagtccctacgccgaagactccattgccacggagcatcacacatttgtgttttacacctgagcctcacatattatgacgcgtctcggagaccgaggtagctgtgacaatcccaaaagaagagcaagatagatagccgggcctgcatctgcacaaaattgtcactccaaactagtataatagatgcatattactattcagcacgtatccattacgtatttttcacaggcagatattccagagcctcgctgtgctgaccaccctcttctgatgttcagctgagaaatgcactcagccccgttcgggcgtgatcatcctgcttggtgatgtctcagacccctcactcattcgcggtgaggggctcttatgtgcgttggattctcctatgcttgtgtggtgcttattattccttccatgcgcctatttgaatgcgtaacacacgcagcaccgatatttagctcctttgccaaccgtattatttatgccaaacgaggacgcgtggtgtcggtgtgaagggaacatacgcaatactcggcttggaatcactccaccgtcgttgcaccagcagacagtcaatagagagacccacggcagttcttgattcgcgtcagtggcttggttgcctctcagttgtgtgaaaacgaagaggccaatcgcagtgtggtattgcacaatcgtgcgcagagcgatattgacatatcgaatactcggtacccgcctggatgaataatgtcgcagcgagtctcgatcgatctgagcggccgccgaactacataaggcgaccgacgggtctctccgccgcctgaaggatagttcgcatggccagacgcttttgccgcagctcgcagaatggtcgtcgcacttcgaccaacgccagtatccgactggaagttcaagaaggagtggaacgacttttactcgaccggtgatttgtacgcgacagagaaacagcagatttatcgccggcagtgggaaatcaaaacgtaggactggcctcaatctttgcgaccgatctcgcctgaatattatcgtactttgctaacttcatccttcacaagcgactctcacaactatccgtatcttgattatatcaagaccatcgctccaggatggaggccactgcagtacttggccgatttcatggaggtcggcaccgaccccctgcgctggagagatttcaacaattccgacaagaaccatcgatacacatatcctgatgatcctatcggcagaggtgagctttgcggacgatctatctgactgacgcattttcatcaaaaggctgactgctgtatagaagaaaaaagatcagagcgcgtgtcgcgcagtagagtctgtctactggattacgaagagaacgaagttgaaccacaaataacatatttcgagcgcccgtttgacctccgcgccaagctgctagagattaatgacggcgaaaaggatcacctaccaagatcaggcctaaagcttttcgtcgtcgaggacctttctcgggataccatcgacctccttggccattatctgcacatcgaacctgacttcttccgctcccatctccgcgagcacgcatggttcaacatccgtgaccctttctgggtaccgccgagccttcacatggatatcgcgagtaggaattggcaacagatattcttttgtcgggctcggtactttactgacctcgcaaaattccgggaagcgcaacgggcggtcgataatttcaacataaagaggaagctagatgaggacgagagcaaggcattatgggatcgaagctatccgacaagcaagccgattttcccgcaattgaacacctcattgttcagaaggcgtaaaaaccgaaacgaggtccccgaaagaaaccccaatggtgaccacaagaacataagcggcgaacatggcataccacttgacgaagtgcagacggcgatcgaacaagagctgattgaagaggaggtcgatgccaaggtcgggctgatgagaacaaaagcgaccttttggtggaagaataacaacataggtaatcatacgctgaatcacagttgttgaggaactttacctaatgaatcgtctctctaggtgtgttattactagacccgactctaacggaagggtttccgctttggagagaacaagaaaactggcatgaaaagccgacaccgggagaggtcggtccaaggactcctgaccctaaatccagcttcgccgagcgcttcatctactgggcagaaaatccggcaccatttcttcgaaaggcagctctcagcaatgacccgcggcagctaccgatgatgattttgctccgtattatctgtgccgattggattacaatgagccagtacattaaaacccgcctatcccaagtcgactgggaattgatacatcccagagaatttctgggccaccacaggttttacacaatcttgaacaaactgcacacatggcgacgccttgtccctgtgtatagagagatgttatacacaacaacattgcacatggaattctttctcaatagtgagggcaaacagtgcgaaagtgtggaagacgaacctttcatggagtatctcaatgagttcaagctcatactgagacaaatggatgagtatgaagaacgcatcgatcgccttactgcagtcaccacctccactatcaacatggtcgattcacatcgcatcaagcttttgacgggcctcgctaccatcttcttacctttgagtctcatcggaacgttgttctccatgtcggagaatgttgacaagctgggggcaacgtttgggtactgggccgctgcgtctgtttctgtcatgtgcttcctgtttctaatctatcgactgtcagaaagttggctggcttaagcatgagaacattcttcttttatgtccaaaatggtggtatagtcgtatgccactaaacgtgaagatattgttgtgcagaatcacaacttgtcattgagctatggtccgccatggcttggacaatgggaaatctgtttttgggcttgctttggatccacattgttatccttaattttggtgtttatagtaggtgagctttcaaacgaatgccgcattactgggaatgaaagccgcccgctttctacaaaacattaataagtctgcacattggccacatgctggcgcctgcgttgtcagacatgttgtcggcgttttcccaaattgggttccgaaaagagccctgctctagaaaaattacttattgtgataagaaagataacaatcttcatcatgaaacatcccttttcgacgtcatttccttctcatttacatcgcttccgtcctattcggcacctttactgtgcggcgtgcgcatccatatcacctgttcgtgcttggttgttgccaaaggtcaaggttctgaactactacttcacccaagaacgaaaatatgttgctatagaatttcattattctatattgcaggccaaatgttgttgctattatttgggggtgtgcgctgctggtgggccaattcgaatcgtgactgcgctaggggctacacgagctcgtgatttacatcgccatttcgaagggatggatggattgcttaagtagtttcttatctgaaatatgatgagaaagcccggtggaaccttgaggaaaataaacagcccaaactccctggtgatggcacaatatgtgacgtgcgttattgatacggagctacacgctaatcaactctgttcagggccggcaatgcaccataaaggagaagaagcctccaagatggggactcataccgaaggcaatagataattggcgaccaaggccacaattaggaaatatctctctaccaaatctagacacataccatcgaacgatacgtgtcgtgtccttcccggtatctagtgaacatctgattcctaggagccgttgcggaaaaaggtacgcctgcctcccttatcttgggtttcagtactttggcaagcatggcttcattttgacccctaagcgagattcaatagcgccggattagcatgtaatacaccctggttatcatcaacccttgatgctctgccaatcaatccaaacgaacaaagagccaacaattattctctcgttaaaaatctaggaccgagggccctgaagtcgacaaatgaatcgaaagccaagttaatgttctgtagatatagagattcttggatacaacgtattcaatatagcaaagggacttctaccaaatgtgtttctatctcaacgcaagaagcaaaatgaaagagcaggacaacacgatgaacaaaagtgtgaacaacagtcccatgcacaccgcactatcgaaaacccgtttctgaagatgatgggttttcgggcatcgaataacttctgcgggggaggtacggtagaaatgagtataagttaaaatcaaccagttattgtcaagagctggtcaaggggggctggcacatatgccctttaagagtaacagccgagtgtccgaagtaccaaaaatgacatgaactgatcaatatttatcccaaactgcatggcatgtcatgtaacatcgcttgaagctaatatgccaattaaccctatagcatccttctcctcgagggtccaacgatcctgagtgtagaaagaagggtacggcttcgaagattcagagtaggtttttgaagtggaatattgggtggccaaggatcatatctaaacaagtttgtacggtatttcaacggctgacaatgcgtgctcaaaatctacaaactgatttgagtcgagtgtattgcttcggttcctcaaaaaagcttccgcaaactgctaaagcctgcagcgcaagggtttcaagataatcacatggacgagattgtcgaggatagcaaggaacgaatacgaccattgctatacggtgaggctagggtgggagctaggatacttcatattcccaatattgaatatttagcagggtagctagtcactcacatgagacattcatgaatggtataaaaaggcaagatgttcctctatcattctccaatcaacaagcaactcaccttaatatctaacgatcgacatccactacccagtcttgcaaaatgaagctcgctttcaccattcttatcgccctctcctgtcaggtgtgatatatacttctcagcataacattgacacatgctaatattacactagtctctggcctctcctgctgaggtcaataagtcccttcgagacgatggcctctatagcggcgaggaagatgtccttgacatggacgaaatcgagtccatcagtatcatggatttcgtcggtcctctcacccccggcggtcccaacgtcactctgagcggcaccgccaaggaaatttatgagcagatcctcgagttgaacccatcctacagtgtgtgggatttcgacgagtatgcggacgatttggaagctcgggggctgacccgtgaagatactgatgtcaacaacccttctctcaagatacgctcatccgccatggccgaacttcatggacgagataatgagttggtgactcgagacagcgtaatgaactccatctaaccggcccttgcgaattccaaatagctaactgctatcagtttaattgcaacattggctcctacgtcggaaacgtatggagtcaatgcggcgaaggctttggttatctctggaatcttggaaaggcttggtgcggcgccaaagccaaaagttgcgcgcgtgtcagctgttctcacaactgtggcatgtatctctgcagcaaggtcagtcctttcagcctcttctctgccggaatccacggaagaaagtgctgacgaaataatcttaaacctcagttgtcgaaggagaagaaggtccactgtggaaatattgccaatgacatggtcaagattgcctatgaatgtggttcagatgtgactacttgggcgtatcgagctagaggccagatgcaattctcttgccacaacaccaagctgtcgagcccgtcctgctgagttatcctgggttgtcgctcctccgatgcttacttgaggtcttgtcattggctcaacacggatacttgtgatattttacacgtcacatcccgtcggttaagccctctattatgtatttatctgatggatttgtgaagggaatgattctagtcccgttgatagtgtagaatctaatataacaattcttcattcgcgatatccagctttcgttccttggcttttgcagtgatggaataccaacttagaaggatcgatagagtcgggaaagttctttagaatgtctactacaaatttaattctccaacgtagatgtttttaagatctttctagtgcgtactaaatgataccttcattctccctaataagtagcagggaatacacccaatcgcccaccgtctgttacgaggacattgccgtttacataagagcccgctcggctggcgagatacaacacagaccctgcaatatcttgggcatctccagcgcgttcagctgggacctcgctcttggaccaaccggtcttctcacgctcctcaagtgtcttaatcgtcagttcgctcgggtaaactttcaatagatgtcagtggcccgctcttcttccttgtacatgcagatgtgaatgatggaacaaagaacttacagccaggtgcgatgatgttggcccggatatcatatggaaccagtgtggtggccagctgcttgaagatgtgggtaacggcggctttggaggcgctgtatgagtaacctaggcccggtcttcggttgaacgcgccgatgctgcttgtgacaacaacctggcttttttgtgatacatttccttgcttgttgccctggtcaagcagttgcaggaaggcggccacggtgttaaaggcgccggtggcattgacagcaaaagtgtgagtaaaatcttccgccccccaattccacagatgcttctgtaactcttcaatactggcctcaggcttcagtccagccaatgatgggcctccgatgccggcattagcaaacacgatgttgatataaccgtgggcagactggatctgtttggcagccctctcaagatctgccttgttcgtcacatcgccttggatagcgtggatattcccgtttttctacatcaattagacatatgcgcaataacacagaaataagtggtatgatgcaaggaggtcattgtatgcgcacagatgttttgacggcctgatccagagactgttgtcggcgtccgaatatgtatacaatcgctccatttgcctccagcgcctgggcgatcaggaggccaatccctacagtaaaattaatcagtaaatcatcactcggatgcaaactcaagatcctacttggcgggttgggtcttcactcaccagtagcaccaccagtaacaaaggctatgaggcctttgacattgaagaggtcaccagactgaattgatgtggacattttgacaacgtgaaggatttttgctaaaactttcgttgaaaagaattctaaaacatctccaattgagggaaacagatgcaatttatcatcttctacttatcttcagccccattctaattgagatggcgacatttcagtggtgatggcgggatcggctttgtcactcgtgtcgggacctgtgcgacagaaattcaaccaatcccatctacatgaatatctgctagtgtttggttcacaagggggagtgtttttgttctgactgagtgctgatttcaaatctgcgacgctgattcaaagtacaggacgctgttgctcaaataccaaacctgtgtgagacagtctcttgatgtgccattgaagtaattactctacagcttagaaataggtccttttatatcctccaccagctctacaacagcctcggcgtagccatatgatgtctgatatccatagccaccgtggccatagttgtgaacaatgctagtcttgtcatccagcttctccttctcgatgcgaacaccacccttgcgagctggccgcagaccaaccgcgtgtcgaatcacgctgaggccggtgattcccttcccgcccgcaatttcaggtcgaatcttgacgatccgcgacatgatacgtgaggctacgttggggtcggggttggtgtcccagtttccgatgtcataagtcccgccaaggatggtgcctccaccggctgctcgctgcatgagatacagctcctcgccaggcccgtcagcagagccggagcagatgaccatgggagtcgactcgttacggacgagagcaacctggccgcggataggatacatcgtcttgtcttctactccacccagcttgaaagagccgagcccggttgtgtttatgatgattgaagccggctttccagtgtggctgaagttctttgcctcgctgatgtcggcaacgattcctcgcttgagcactacgccgttgcgcagtagttggcctgccagccactgcaggtacatggtcgtgttgatgcacacaccggtgaactcacacccgccatcatacccatcaggcacttggcccttggggagctcacgaaagtcgtcaaagatattcttgtaccaaggggtgggactaaatgcgtggacggggaaaccagcggggtttttcagatcatgctctcggtgaaggatatggcactctatggtaacctttgttagcaaaccacaaactagagcacagctcatctctgcgaggaaaacaaactctggaagtggatgcccgcttcgggaacctcttcaacaagccgtttcagttccttccaagtctgagactcccaacgtttttctttctcttcggccatgctgcgaaatcgttaggctttctatgagaaatcaatttggacgggaaaacctacgggacaatgtttgctccagcgaacgggctggcatattctccatcgtaatcaccgggcatgtgcttagcgacgacggtgatcttgtatcctttcttcttggagaggagaagcgccgatgtcaatccagagacaccggctccgacgacgacgacaatggtttcggccatgggggatggatgggcagcgttagactagtatcgtctcgaaagaaaggcgagatggatgcaaagcactacgcaccctcgatatgagacagtgccaatggggttgaaatactttggttatcttgatggagagtcagggccgggaaaaccttccgctcaagcggagatggaccagcgttactaaacaagccccgctcgatagagctccgaatacgctcagccaggcccaatctcgcctaaaattagtggctccatatctcaggtgatggaatcttgcatgagagatcttgtctcatcgaatacggggtggccacccgaaggtgtaagccggcgtgccattccatatcaatccgctcgactaactcttacattgtcagaggcccgacccgagccaaatgtatcacttcatgtattatttgaccactatgtagcttcggtggaaagttggcccgtcagtttgctgtcattatggccctatcatcacctaacacttctagtttcctcaatccaatgagggtttattcggcgttgccatactgcttattttcacgactgtctcaaactacaggtcttatttcccactatgctcatcatgtgtcataagccaagctagaaaaccaccccgtcgaatcccagccatctagtgactctgcaatcgtctccaagcgatgcgagggcgaatacagatcctccgcttcggcaccttccaaccagtccggcagaacaattgacccagtatcaaagccttgcatgtcagactgagacgaggcaatatccgtctggtcagctgccaccgtcaactccatctctccttcttcctgagtgtcatgagacaaatcttggcaatccccaagcattcgggttaatgaattcagatccatgagcctagatttggcagggagattgccttttgtggccatgacttgaaggctttcggaaatggcaggtaaagatgggccatcatgtttgagcagagaaggaaaacatgcctcggaaatagcgataaacgtaccagcagagaaagccgcctccaactcaaaggccagaaacgaatctatttattatcttggtcagatgcagtgacgaacagtgacgactttgtaggctcacctattaaatgctgctgctttaatgcgtgaaggacggcacttattctcttcgcagactcgattccaattttcaggatgtggcgaataggctccttagaaaataagacggcgactctatcctccgagctcttacaccgcttttccagaaacaagtataaaaagggtctcgtagcaacaacaatgcactatagatacatgtcagcagccagaaacgctgaatagaaaggcatagaaatacatgatggtagagtatgttgagatgggcagcaataggagatatacccccaacagaacccggagcaggtaaggcgaaatgtgtacggagctcctcagacacgctcgccacgttgcgaagcgcgtcttggatgcttccaatgaagttgaggtggcgtgtgctcccacttcggtacacggcttcggatcaagtcagccaagatatcttcatgctggattttaccagtatacgtactgttcacaacatgcgcgagtgcccgcgataagcccacctgtatagtcagggaggcattgcgttggtttgaatcaggaaatacaggcaatggggtagttatatcctcgtctcgcacttgaatcggaagcccaatcaagcacgatatctgacgatctaccactacaattgtccaccatgccttccggcatcgttggatcagctcctggtcgacttggtcgggctgcatgggagtgtgcattcctgaaccaatggcgattcttacggcttggccgatctagattcggtcaacattcaagttgaagaatcgaacatcaagtggtaaaggagagagtattaccttatcatatgccaagactctcgcgtcaagagcttgatagtagagtgcagtgcagcaaagaatctcagttgcagtaacgaagtctccaagtaagtaggtagtttccggtaacagctttacagcacggacgaagagctccgagcctggcggcttcccctcttgaacctcagaaacaacaaaagctttgccgaatgcgaggagaatgagaaagtgaatgtaccaaagatccatcttcgtcatattttcgacggggtcagagtaaaaatgatacagctggggcatgaatgaagtctcatcaaacagatggtagatctgcccggcatgaaatttcacggcgttgagaaggaagatggcatagtcgagagagggtaacgcatcagtctccgattcaacagtcgccctctttccatcccatccaaggccagatgcttcagccggaatgtaagtgccatatggaaagggatcattcgagcagcgggcgtgcaacagtcgcagtacccgctgtgtataagagtagtttgaggaatgaccaaggtaatctaggtcaaagccatcttagcatatgcatttccataaatacgtcacagtcctattgacttacaaaaatcacctcccggtcctgcgacatgggtcaagaattcgggagaatacaccgggttagttatctcgccgttctcaacatgaatatgagaagtgggtgttggttcttgaagacagacttgacaataatcagtttgggttttaaagtaagccaacacaaggtaggggcatgcttacccgaaggtttatcttgtttggcctctagtaatgccagctttgtctgcaattcagacaggtacctaagatcacagccatgcacgctcagtcacccctcttgccacctagccttacatggaagtaacctgggactaccttttagagacaaacactttcgcctcctctaattcgtattcacagttgaacctccggcgtctacatgcatcgcaggggacctttccactgcatttgatcttatgccgacgacaccggatgcaactccaccaaaatcagcagagcccagagaaagaatatcacggaatcacggaaatgatcttacgcattggagcttcgtctcctcgtcgtttgttcttcttctggactcatggtatatgggcgtctatacacacggcatcttcgatctgccacgcagaggagagacgttgtccagtgcaagttcaggtctcaagggccagtggagcatctccgcacccccatgttccgttcatgtacttcaccagctgtcagactgtagcgttatcgtttagttgatccacccaatccttaaagacgaaagcatgattcgtggcaagtctcatacccctctgccgatatcggatatcatacccgagcatcccagctggcaagctcaaggaatttgccaatcatctcgtggtaggatatctcactattctcatttaaacttcacctgctcatcaaagaaaataatgttgcatttttaattccacatgatcaccggacttgtaacaggtttctaagatgaatccagacgcgcagagtcaatcttcgttctccttgatatatgtcggcttgtggagccgacctaccctgtatcttagtaggcccctttttccatggtatggggaatagataaccgaggcagtgaatagaggtaacattaataataatctggaaaaagatggtacctggggcttcagtggagaaaataattgctatttcgatgctaaataaggtgctttcgtagaaagaaagagtggatgttctactcggcgcacgaacgtgatctggactacggttacgactagagtatcgcgcatcgcttttcatcatgcatttgaaatattactccagaatagggcgatgagacaattggaacgtttaaatgatagaccagtacctctcagaattcattttctatgaagacttaagtatgctagtatcattcaggtaccaggtcaaactttccaactcgcctgttggatatttctctgccaaagtccagccattcccaaaccaaccaaagggatttccatcaaaggactctgtttcaaaatcctcccatctgaccgaggccaatgttcgaagacactgaagactgcttcccggccacaaagctgtgacgcgaccattcatctgcccttcctgtggcgcaccaggcccggctgtcttgtaccacgagctgcattcctctgcaaacacggtgcgcttgaagaattcatcgcagtagttcgtaaacgactggactgcctgcttcttgggctctacccgaccgatgttgtcgtaggccatgcgggcgaggatttggccaatgtagacctgggtcttctcaataatgaggagcagacttccagcgccaggcatggagtttgggcccatagactggaaaaagttggggaaaccatcagtacaaacgctgagataagtttcaggacgaccctcgaatcgctttctgaggttgatgccaccttgtccataaattgggaaactgcggttggctggagaagtctgaaatccagtggcgcagatgatcacatcggtgttatgtctgactccgtccgtcgtgataacaccattctcatcaatccgatcgatcccgcatgtaattgtgtctactttatgggacgccaaagcctccaggtagccaggaccgggtgacatgcgtttgcaatatggcgaatacttgggttgtagtatatcgtagatttccggtttcccttgcagtcgtttcttcatgttctcttcaacgcgcaagcgagtttccgcctgcaatttcgaatccttgaatatgacgttgaatttgttgttgatatcgtattcaatgccccggcgatactgcaggtaagcctcgcggtcgtttccccataacttcttttcttcttccgtatactcaaagttccccccattctcttctattcttctccccatactgcctcctccgaagagacccgcgatccatgatcgaccgcggacatagtgatccatccgcttgacttgtggaagaatcgacggtacaatctgaagtccactgctcccagctccaatcacagcaactgctttgtcctataattatcaatgttagagtgcatgttataataccaagtagaaatggctggtacctttaggtcaatgctggggtcccaatttgcgctgtgcaagatatcccctttgaatgaatgaagtccaggaatgcttggccacttccactcattgagaacaccctcacccgtgacaagtacatcagcttgatcctcgtagctatcaccggtggcaaggtcctgaagctggacgaaccacttgccagccgtctcgctccagcgagcggccgtgcacttttgacggaaccgcatgtactttctgacatcgtacttctttgcgatagtcttccagtactcgagaatctcagacgccgaggcaaaaaaggagctccagttgggcgaagactcgtatgagagctgatatacgtgcgctgggacatctgaaagcatgatgttagatgatgactagaggaatagaagaccattcgcactaggaatttagtaacttaccacaagcacaaccagggtatcttttcatctctcatgtcaacgggatatttcttggcattgggtgaagaggaatgggaaactaagtacctgttctcgaaccatgtgccgccaagctcctcatttttctcatagattaccaagtccaactcaggtactcgcttcttgaattcaatagcgcccgtgattccagagattccagcaccgatgtagatgaccttgaggggccttgcttggtccatacagcgctgtgatatccacacatccgggctttgttggttgagcatagcagcctgcggctctggaatttgatgtccattctcgttggttgccgtattgtggtgtaagacggacttgccattcgccttgggcgactgtggctccggactgttactgagaaagtgtggcatattggcacaaggtggattctattcgctttagatgactgaaaaacactgtagcaccggaagaagggaacctagagtgaatatattcattgactgctgctagtgggtggaccagagaagaccagaacgtctcccattccaggtgaaacaccaataccaacattgactatcgcatttcttagattgggtgtccctccccgcaattagcgcttcctgttcccgaattctacatagtgctgttatctgtcccatctctatctgactctcctcgaatttgggtaaatcgcaactccttaccgaacaaatcggaaacaatatccgactttttataccagattgtgggggttttcgttcgcgcgtgatacccccaactcgcctcctagcccagatcagaaaccgattgtggggattcggtaactgtatcctacttgttcaatgtaaatccccccgatgctcgcattgagtcgagatacgagccaaatctagacaagaggtcccccaggtactcggtctttttacccgttctgaatagccagtacactatgctccattacactagcgtgaagttttcttgagtagtctacgccgtgagtttccagtcctccaacttatggtcttcctagacgagccacaccgtccagaagccgaagatgggtggtgtgtaggtgggcaaggacaggccccttttattaagccagtatttccccgcagtcccgaaccactgcgatagtatcatctccacgaaagtctcatccgtcccccagccatcaagatgtcatttccagaacccatcctgtatgatatcaagcctacggctttaataccaaactctcttaacccactccttctatataaaggcgtgttcctcaaagatggcaaagtcgacgccgtccgtgcgcttgacacttttagatcgaatggatgggacgttcaatgggtgacaagatatggtcgccaacaacgatcgcactaccatgcccatacccatgagatgatgattgtcctctccggaccaggaatcattcgttggggctcagcagacctctccgatgatccggaagagcacacttatggagatgcctacgaaaagaccggcgtggaagttgaggtggagcctggtgatgtttttgtcatcccagccggtgtggcacacaagtcctacaatccacaggccgagggtgaagcatttggggtcttgacaggttcagcgcgcgggattgagtcattcaagccacgggaaaaggtggcagagctccctttgcatggattcatgatgatgggtgcctatcctgtcggcaacagctggaactggggcgagggaggcgatgatattggcaactatcacaagatttggaacattccgaaccccaagtatgatcctcttgttggcgcaaatggcggtattcataaatattggaagcaacaaacgtatgtgagcaagctgtgatacatatatcttcgcattctacatctgcagaagcactgagaaagggtagttctgatggacaatgaacgattttaaatatgagcacagtttaataacagtcattgttgaagcaaccgtctttctgggatactcggaacgaggctgtattaacttgaaggtcctatgtaggatgcacattaaaccccaaagaagtcactagccatggcatcattaatgaaactatcccaaaggtcctggctatatgggaagatgatgtgatgcggatcagcagcatccattttaaggtaattctcgtccgccacagtcacacaacgtatcaagttcccaatttccgcctccaagtccacagagagctcagagctggcttctagttccatcatggcgccgagcagcctgacacctcgccgagccaaggagcttctctgttcctcacggctgataattcctttcccaagctgcaggtagcaacggatcttgtcccagtcgtgcataagggtgttctcggacttgaacagcaaggcaaaggccagattaatacagcaactaatgacgtgcgtcaatgtggtccacatcctacgtgcaatacgtgactgaagagtgtctggccaatcgataatagccgcgatactacgctcagcaatagaaacgcatgaaaactggaggaggggcaattagaaggactgggagacatagatggggttcagatcaagttacttgagaaaatgcatagcgccggtctcggaaaccggagagctggaaatgacgatgtacgccaaggacctatgatggtggtgattaatgttagaacaccagaagtagttttcaccgtcttgaataaggaaccaacttaccttgtgggcagtacatacaaggacaaggcctggcatcaagccagtgggaagtccatcggcagttgggacatcttgtggtgtgtcaacctctcgcaaagaaggcagaagggacaagtagctggccttcagctcttcatcggcccgtatgacctcctcgtataacttggggatactctctggggaagtgcctggatgtccagccttgaacatgcgatcgtggtgtttccaaatcagaaccgagactgcacacgaggagttagcagaatttcagtagcgagggacgtttgatttacggtgattgacgtagttagtccaactagttgaagtataggcctcgtccaaattcgccgtgccatcgctcgcttgctgttgcgtagctacaggctggttggtcggcatgggtgtactgaactggcttgggtgtatctgacaagtgttttggaacggtatttggaaccagtcgtggcacacaagaaaccaccagatccctttcttcagttcccggtcagtattggctggttcattgataccggcggtgcttccttcagaaatggtgcgatctgggcctagacggtggaggcccaggcactgagcgattcgaattgccgtggaaatgagaatgcaaatgaggtcagacttgtcaaaatggtgcgccacttggatgagaagacagattgcttggactgaatatatactgtggtcatccatgaagttggcttggaagagcatttcgatgctcttgttgaaaagcacaaaggatgcatctgggctggcttaataggccatgttaatgtcaaggatctaccgaaattgcacagctacacagctaaagtctagcaaacataccattgaccggctgtggcagcgaggacaagtgctgatcatcgatatggtacagtgtttgctgtaaactattattagcatttgttcttgttatgagcaggttgtgaaatacttacagacaggattgcataatacaatgctagccaagacctgttgcactctcgtctgacaaggtattcttcaaactcgtgccggaatatgggcatatggactgcgcagtgcatccaggagagataggactggtgaagggccaggagtgtccgagaattctgttctgtgaagaataaatcccatggctcttccacgttgcatttgctccatgaattgagtgacgatggtgactccgcggtatcatgcctgccagcaaattggttgatgacgttccgacggccatgggtaagaaattccaatgctgccgctctatcactggttagacgactgtcagccgtctggggcgcgttcaatgtcggttggcgtcccagactggggcgactagagaaggcatgatccgcgataggatccctgggttcagggtaaggaatggcagatgcgccttgaacaacaatgttgttaccaatggtctcagacgaagaatgagaatctaccgggagcacatctctggcttggtctgagtccggcaggctgggcaaggggctgttgccattttctaagctagtgacatctgtaccatgtcctctctttcgggtgacgacaacaacctgctctctttggcatgacgaggccctgttgagtcgtacgcatgccgtgcagggtatggtcttggaacatcgaatcttacgccgcgcacatgcggtacacgcacgcacgcttctctgactacttctgacgggcgttccagtcgacattttggcagagaaagggcgagattggaagcacggccgtgttgagataataagagatggggatggtggagagtctggcatcaaggtgggcactccaacccaaccttgctgactcctcggccgagtttctcgaaacccattagccgacaccgcattgccggtttcggttgcttcggaagctgagccgatttgaggctagggtgacgactggttgtctcacattcttttgatcaagaggatataggttggaattagcatagaagttcaatggagaatacctcagtgcccggtggcattatgtgaagtaagtcgggagaaggtctctcagggggtcgtacgcggagagagcctcttgaaccgatgagcgagacgagcttactcctcacccgataatttcgttttcatctcggccgagatttcatcttgtccacccctacgagcaaagggacagcaagctcggaaattaataaataacacagtcaatgaagcattgagtagttcctcaaagaaaacatacgctctaaccgtatccaaggactcgcccgagctgtttgttatccaccacgcgcggaagacgaccgttggagctgtcgctcgcatttctgtgctgtgtactctcactcttctatcgcttttcggtcattttcgtggatcaacacagtatatcgagtgcttttagcaggtgggatatgcgtctatggtcataataccatttgcattattgtcatttacctatatatcgaagaaaatgtttgtgaaatcgccgatattgttaagtgtcaagaggtaaaccatcacctatctaccgcttttttttttctaggtaaaatcaaaggctgactgaactaaacagaacgcaaggccaagaggggtcactaccagagacacagacatcatccccctcaggtacagaacctgagttcctccaggtgggctgggacggtggtgatgatgaccccttgtgcccacgcagcttcagcaagccgaagaaatggatgattataactatcctcgctatggcatgcttttgtgtgtaagaattgtctatagaatccggaaatggagtaaacagcgtttgagcactaacacttttgggttcagcaccgcagcgagttccgtctacacttccacataccagcagatggaagagtcatttggcaactcaaggaaggtctcggtcctgggtctttccctattcgttttggggatcggctgtggccctctcttctttagccccttgagcgagttttttggccgtcgtcccatatacctcgtcgcatggatcctgtatgtgatttggaccattccccaagccgtggccaataacattgccacgatgctagtcgcgagattcctcgcagctttctcaggaggcacatttctagccgttgcgggtggaacggtgggtgatctgttttccaaagatgaactccaatatccaatggctatctttacagtatcacctttcatcggaccttgtataggacccaccatcggcggttttatgaattacaatacacactggaggtggacgtactacgttatgttgatgtggtccttcgccctactcatggcaatcgcatttcttgtccctgaaacattccgtacgttcctgaacaacattgcccagaaaaaaccatggttctatgtgctgacggctgtgcagatcccgctgttttgcgacagaaggccaagatgttgcgacaatctactggtgactcgcgttggagagctcccatcgaagaacaagacaaatcgattctggttgctgtttgcaggtctttgaagcgaccattccaacttctcatttttgagcccatgtgcctcagtctttgcatattttcagcacttcttctcggaatcctctatttgttctttattgccttccctcttatctttcgtactcaccatcagttcaatctttggcaggtcggactctcctttttaggtataggtattgggctcatcatcggagtcctcaccgaccctgtatggtctcgcatccgtctccattatgtttccaaacttgtagaaagcactggagagcctagtaatggggagccagaatttcggttgcctccagccatctttgggtctctgctcgtcccacctggtttgttcatgtttgcttggacgacctatccttcgatacattggattgttccgattattgggtcagctatttttggcacggggtgagttctgcagatgaagccagttttgcttgaagcattcaagttcgtgttgaaatgggcaacgtggctaacctctgataaatagtaacatccttgtgtttacgggtatatttgcattcttggtaaattttcactgaaccagattctaccttcattcaatcttactggcttccacaaggttgatgcatacccagactacgccgccagcgcattggcagccaacacctgcgtacgttgtgtattcgccggtatgttcctgtgacagcccctagattatgctcgtactggaatatgctaatagatggacagccgcatttcctcttttcgggaacgaaatgtaccttgctcttggattccagtgggcatcctcgttattggcatttctcactttggtcatggtgccattcccattcttgttcttcaaatatggtaaaagaattagaaataaaagtcggatggccaaaagttgaaaggagacagatgtaacgagatggcgggggtgagagacgcttaaagataaatctttaaaacatacattcttgtccttacataaacacagtactgttgggcgaatattttggtggcttatagaggtggaatgttgaaaattctttgttgcattgacaattttctatgatgtgacaatactccctacttaactgagcgtgttcattcttcatcatctatttctacactcacaaaagcaatctcaaatattctctaggagaaatgccactctttagtgctcctttttattacaatagtcagtttcatttccgctcgggacacaaactacataaaccgtgcaggttggtcggaattccttaagggaacgagaccttgagcgagggattagcctcgagcgccatttgactgagcgattcataaggagtggtgatgtaatataagttcactgccgcgcttccagttcctccggttgttggtttctgagcatccgggccaataatcgcatggttgttgtaacgttctggtcttagaggaactcacttctctctatggctccgggggcagccaatccggcgtctacggcactgtggctgcaattttcctatacctgggctcttactcctctggcttgactccgttgacagacatgtgcccccctgagctgctctcgtataacctccgagccacaggtatagggctgttcacagtcctcgtcaaggcttgtggtattttttttatcatgattttcccattcatgttcaaatccctcgggtggaagacctacgtggtgagcgctagctgtaatgctgccttcttcgtccttgtttacttctttggggtggagaccaaggggaagactggagaggaaatcgatgtgctgttaggtggagtcaagcactccgatgcaccggacctgaaagccgtggatgctgacgagtaggcaatcgaaactatggtcgagcgtgtttaattagagggcaatatcctcagaagatgaaagggtgcgggtcaatcagctagacggattcatgcttcatatatcgggcatcaatagtcagtcctgttcagctaggccataaattcattaacagacagagtgttacctgagggtataacgttatctcccttacgtaaaggtacagttggtgtaggcaagacgcagtaggtgcaaagctgatgcacaactgatgcagagcagttgcactgtggcaagattctatcagatcggtcacaatggtcactcatcgatacaggagccaggttttagatatctgccttgtcattgtcagcaaatgttgtctttatcttcccggttttgcgattgtcattaacgggagagaaatcgagtataaaattgtaatcaacaatgaaagatggcacacccgatatctcaacacaatgaagacgaaaggcaaatataaacgaatatcgttatcaaatcctctggcttttctttccatccgtgtcccttctttttatataatccccccaactcgactattatattggcggttcataatccataacctaacagctagccatacctacgtgacatttaatgcattgaggtgttgagtgccgataacgcccgctctatcagcaatagaccgaaccaacaaatcaacggccacttcttcgccttcatttcctcgaagccctggctggcatcagactgcaccactttctcgttcatttccaaaccagcttctgcgacgttgtcctggtattctgatcgaaccaacctccgctgtgctgcttgggcgacccgccgctctcgaatgacctccagcacccacacgcagccaaacagacagggctgtaacgctgcaaagataaatacttgttgtttgccaagctcgccaattaaattgctggcaagcctccagccgccccatccagcgagcgatagtgtgacgtaggtcatgaagcccttccacgaggtcgtgcggtgaacgatccagatccacgagactgatattttaaacccatttgtcagtccgatatgttaatattcaaaaatcggtgctagcaattccaggaaacttacggggtaatataagcagttgggcagatgccatggccggccaaacaaaagtattgctgccaagcatggagcaaccgtataagcccagtatactgatcgtgctgcagcccaacgtaacggtgtctaatccccaaaacaacaccattctttggttaatagagctccaaagcaaggctttctcatgaatgactactcacggatgaaatgcggatatatccacaggagaatagtgatgaaaaaggtgaggagacagtaaaaacttttgagcccgacattcggatcgtaaaagaacaggtgatatgtattaattaaagccccggagataatgctgttcgagactgtagccatgataaagaaaaggagggagatgattgtggcactctgcggtaacttgaagtcggagtctgattagtatcacgagcacatccaacaatgatcttgcagagaagcatgtcaggggatgcaaaatagtagtggaactcacgtcttggcgtgcccaacggggagcgtgttcacgcttctctgcggagaatttgtgccgagctgaccggcgagtcaaggacactccctcgaaactgttagtccatggttttacttccggtagatcgagcagcgaggtgctgaagagagcaaagatggatatgtacaaggcaccggtagcatgctgtcgggccttgtccctgtacatcatggccgatgatgtaagaaacagcaatcgaaaagcagtctccctgatcgagtgccatgagattgtgtggagaaccatgtatgggagaaaaagtccaatcgcgatgccttggaatactatgataaagattgtttcatacttcatcgttttagcgatggacaaggattggaaagcagctaaagaccaacgttagaagaaaacacgatgaagacagaggtcatagccgatgaaatgggacgtctatataccttgcaaatataccatgggggcgacggccctggaaaagaggcgcttatggaggaggaagaatgcaattggctgagcgagaacgaagccgaagaagagcaagacaaaagagttcctgtgagtaacttcggagagctgtataattcggtattgaggcgtagcaatctaggcgtgtcagttaatggctggagtatcagatgatttttcctgtctgcataggcaaaaacttacacattgtattatgaaaaaaaccagctccggcttccattctctgctctttgtcggcgcctggccatccaagcttgagttgattacatcttcatcatgaggtgccttggtaagtttcaagggaaatggctcaagagagaggttcaccgatctggctgacttcatttgctggcggacacattcctccacccgcagcgtctcctcacgatggtaaacgccagtctcgtggttgtaggagcagagcatcgcccggtgtccggcagcatcttcaccacagagcatcattgcaatgggaggagcggcgcagtttatcaccctgagagtttgcgcacacgtatctattagcgtgaaggtgaacttgcgcggggctccaggctcataaatggcagtttcggagccggaagtcgtcgttgttgatgaaatctctcttaatcttccacagtgatagccgtagatgtgtcgctcagcggttgcgcaatccacaacaccttccatcccgaccaaccgggcgcttctcagatctgtgcgtctgattttccattcatagagaaagagcgcaggcaaggttagtggtgtgaaaattacttgaaccataaatactagaaaaagaaatctggaaacataaccttggattgggtcacctccaaaggcaaatataagtaagtgggcaatccgataccatgtaaacagcgggaaaaagagtagaatgacgaatataatctctggaaaaataggcagtcttccctgaaaggtagttttctggatcttatcccagcaaataggtgcagcgggaatgttctgaacctcaacggcgttcgacccagcaacgtcaaccgcatcacagcagggacggaagtcttttagtttcacgccccagtagtctctcgcatctgaccattgggctcctggctgtgcaggtgcgaggcacagcaaacgagtaagcagactgcttccctccacggccagggcgagacgggcaaaggctcgaaatccagagtcattctgattcaccaccggtctctggctatctgggaagagccccatgacagcatacgcgatatcgccctggctgaactgatctgtcttccgccgagcgaaacactccagagcgatgctaatcagctgtgtcggggggaggatagccgaaccctcgtagtgattcaccagctctttgacagactcggcatcatcccaggctctctcagcaaagttccgcttcgctagagatttgggctcattcacatcgccggccacacatagcttgatgcggtactcgttcgggcagaggagaagttcaggtaacgtccataatcgtgagccccattgacgcaaccatttgttggcatgctcggcggtacccgagggaacatttttatcgccattcagaatgttcgcctctttttcatctgctggagggccgatagcaataatcattgagtgcgcggcccggacaatgtcacaaattcgatagacatcctcgcttttgctgctaacgttagcttttgcaacgccatccgagtcgcgcacacattcgaaatcaagccaaaaggcgcgttttccagcagccaaggcggcgtcaatgccccattggataagggtttcgcgatctcggtgagccaaggtcctgtttgcttccctgatctcctcactaccatacttcgtccacgcgttaatctcggcatctgtgaaaactcgaaactgcaggcgggtataggatacaaagacgaactctgtatctgcctgatcgccatgctgctgattataatcggataccttcatcgtgctgtactttctcgtttctgggtcggtgatgaagcataaatacctcggccccaaggacagcccccgtgactgaaatcgagaggaaggtgatgatacattgctgacacttgtctggtctggtctggatgatgctagctggcccccaagttggatgttagttgaggagggatcacttgataaaggtagtgcctcgcgggcctctaaagatgatgatgatgatgatgatgatgatgatgatgatgatgatgagtgtggcagcggtgttggcaacttggggtattggcattgtgtgtcaatctgttctggtgatttgctcttgatatttccaatcctcgctacgattgaggcgagagcgttaggtatctaacctcccagcgtcagttgaattgaccatcgccacgttatactaggtccaagactacaaaccataagagcgcatagagggcctgccgcgagaagcctcaggaacaataagaagcagggtttgagcgaataatccaccctctcgcttcccttaacgagtatcggagataaaacccagtaccaaatggcttccatagtgccggccttggacaaaggctcccctagccgagtccatggcacgttctcaggcagtagggaaggccgctggaagctctgcacgaccagcggaatgagtttcccatctcccggttgtgggtacaagaggtgaccacccttgtgtgtatcagcatcggttgtgggctgttcggtcgaggacatggcggatgcgtgtttaggcgttgcaaataaagcaccacatctgtttatttatttcttcttcccaggatgatgagcaggaaaggattaaatccaagctatggtcgggatctagggagcagccgcctcggcttgcgatatgccttttcgccacttcgtcatacagtggcggtgcagtattatttttagaggttgctacccaagtgaggctcggatcagcaccagccacttttggaagatcacttcagtttggagaagggtgcaacgagggctgagtccctggcattaaagcatacaaatacaagccaatacctacaaggctgcttagaaagtatggttcacctattttcaagtacgccacaatggtccactcaatgaacttgcaataagaatgtaactattacgatttgtaactgctgcaagcttataataaagattgttatcgagatttcttacattagtaacatcaccttgggaagaatgtgtaatatcaaagagcatcagcaagtaattattatatgcctatttgaaccacaaaaaaagaatgaaaacataggagagtaagaaaccgccattcccctcacccacctctttttagtcccgcctcttttctgtttttagttttcaactagcaaatcaaaacgtcagagcccgcttgcaacgtattacttccccgtggatacagttttttttttgttttttttcacctgctttctggcgtttaagtcgcaagagcactcaaggtaaccatgcgttacttgccaagcagaaactaacatgtttgcgggttattcgatcatgcctcaaagcagaaaatacaaaccgggagtgacgtgataaccccatctagtcttaagaagatatgaagtaccccgtcctccatcgagtcgcgttcaaagcaatttgttcgatcaggcgggagtataatccttgatgatcatagtcttctgcgcggaaggggtcttgttgtctgctggcagcgtaacctctgctgggagcttgtagaacgacttgatatcatcaatatcgctcttctgcacctgcggaggcaagttgtaactcatcactgagagcgggtttcgtgttccgtagacctgtgcccctccctcataacgcagggggtccaaggcaaactcatggcgtaggcccagagtgtggccaagttcatgcaggaacgtgttcttgagcgtctctttgtttttcttgtccgtgaaagagaaactgtagacaaacagggtgttcaacggctgggtgttgttggggaaaaaggccgatgccataacgccgcccttctcaccaccgtattcgagaacaaatgcagcttgcttgaggttgttcacccacttgaaggtcacacccaagttgtagctgttccactgttccgccgcctcccacaagctgacggccgcatacttggcgtcatctgggctggggtagccgttggcataagtggcaaagttgataacacttccatacttccagcgtgggatctccgtgaacaagccaaccaagatggaagccacggagctagtgtcaaacttctcagtcacgcaggtatatttggcctgaagattgccgttgcctgtggtactgttgttggtggaaggttttttgtaggtcttgagaacggtttgtgggtcaaggacttccagatttttgtcggggaacaactgcccaatgagtttgagggcagcatctcgccggtcactgatagacaggttcttatcagaagggagactagcgctcggcatgatgggctgaatgagttctctgtcttcggggggtggatgtgatgatagtggtctggacgatgaactttggcgaggttcgttcacagtcccacaccaatctgtgtttttgttttgatccgtggtaacagatgtgaatgatttagagttgggattgattgcttcggtgcaggttgggttgaagagttaggatagggataagaagggacgcaaggcgtgtcttatatagcccatgacagttctattccttctctatcgtcttgagaaaaactcattagggtaaagctggaatgtgtcgatgggcctggaatcgcttcaaactttcaaagattcagcctcagccatagcatgcctcatatccatcgatcagcagtcgagactccgggacacaccaatgaagtgatcttctgacagtgattcacaacacatggataaatcaatccctagcatatgataaaatgaaatgttcgacggaatgaaggcacctaggttttactatatcttcattcgacggtgaaatgcgggtggcaaacttccctcgactttttccaacccaaatttctgcatcatgcaccactattttgcatatgggattaccagtgagagagtttgggcacaaagtgagaaacggaaatggaagatgccaggcccgggatgtcaagacactgaatgcatgtgagattacacatgagaaaatcatcttaccactcgtgacgttctgtcctggaatgtgggctgaaccccgcacgttgttgaaccggcacttcatgaaggctactaactttggcttggcggctgaggttttagttccaatattacaaagtttatgacagatcagctttgcgtggcgttaatctgtcattgtatcgtaaggctagcagggataataaggtcattgattgtatgaaatgcccagtgatcttcctcgagccgtgccacaatggcgatccagctgctattgagcattgggggattggaagtgaatttttcaacggtgcgatctgaccagcacgctggcaaatgtcctcggtcactttggctggctcgtggcttcaaggttacagaatgcgtcatgtataccggctattcacccgaccagccgtcgcctctatctctatgcagatcatgtgttgagaattgtcgcaatattacacctgaatgacaccattaccgggccagagggaagatctcgcccagtgcttcaacgaggttgaactgcgagtgagatactttgaccctttgattacagccggggcaccaaagctggtaatagagaaatttgcctgtgaaggggaccagacaatctttacgcccgaggtattgaagctatttcctttatgttactattactcgctgacgtctcgtcgagtggtcagtcttattaggaagacttcgcaggcgggatagttgcacaacttgccgccacgcgacctagagccagttcaagctagcaagagcgaagcgattaggcatattgatagatcacaaactgtatgagactgagtctccgtggtcgcttggcgggcaactgtaaataagggaaattatagatttgttgaacggaaatacggaagaatagaaagccctgtgacctagtagttacttgcaactctgatcttagaaatggatcatatcaaggaagttgatgctaatctttaggttaatctccaatgaatactgaaatttacaatcagctcgttcttgtttcgtatcgagtcttagtcactttaaagacggcttcgtaagtgcagtaaaattcttttctttgccacttcaggtgatattgtgtacaagcaaaaatgacagagtacaggcactctatcaacattcgagcaatactggatcctgccgaggcagaagtgcaacctcaagctttggttggtacggttgttcttacaaacgagcaacatcaataaacctcttatccggtggtaccgtatggagtcacagctggctaacaaattgagatccatcaggcatggcctcacctggtgacgaccttagcgactccttgcaccatgatcggttagagcgaaacgcgcaaatcagaggcgaggcgaggcgagtgaagacagaagctagcagaaaccccccattatccgagccaatgccgtcgtatcgttcggccggtgacgtgagacggcagactctaatttcctaatgcttactttggctgcataatctctttgctattctatgggctgctacaatggggcgacagattttggcgtggacataatagaagatcctttttaggggtccattgaacgcctgcgagggctggaaccgtcaactcaaccaggtcagataatgcgtcagcggtgtagcgaagaaagattccccggcatattgacggcaccttgataagtctcgctgacagcttttattcatcgcgcacggaggcgggggacattgtaactgatgagattatcgaggggttcaacaagcaaagatatattggagaagttgtacattacatcgagtatatcgatgaccgctggaaggacagcctaccaagtcggccggtaaccgaaccaattcctccaaacgttccagcggcccgattcgtcgtgtatggcattggggataacacagcaccacaccatagatttgagagttgaaaatgcaatctaacaaccgcaccaaaatcaagcaacattccacgttagctatgaaactggggggctggatttgtgtgtatacacaatcctaggaaatgtgccagtccaagcatattaataagtttctttgtcagacctatatattcccattacctatccaggttactcacgggatcagagctagaccatctgttcgtaacggatgcttcagaatctatccttccatgttacttctcatataggcacccagctcctaagcccctctcttgctatgttctttacccaaatgaaacgatatcgccgaatcaaactgagcagcaattgagtatggatattgtttgccgggattttcaagagacgattatattaggcaagtcgattaagctagtcagggcagttgttgaccagactaagcttccccattccaaccgcttcaatcagaatgtcgatcaggctcgcagtacgagctgatgacactcaggcttgccgtgctggtccggatctacagcatacccggtgacatacggcctccatcccaccaatgacatagctgagttcgacattccctccactctctcactctcaaaactcatagattaatattgagtggaatgattctaaatcggcatatattaatcagagagtgcatttatccagctccaacagcccaatacagatcacagtgcggaggctaagcgtccgagagcgacgctaggcgatgacgggactcgtgatccctcggctatatttcctgatgcatttcatgataccccatactgcaacaccattggggcagtccggcaaatacggcatccagtcggtagttcggtggaattcttatatataactgatccgtaccaatcgcatctaatggaaatacccattagcctagccactgtaccaacaggaatatatcagaagagatcagaagtcacgtagaattatatataagagcaattcccggtatagcaacgttgagtgattatccaaacagcctcgtgaaaatctatcgtttcaacatgccctcgctatcctccaacatcgcgcttggcctcattgccgcaggcgtcgtcccgcttgttgccgccggaccatgtgatatctacgcctccggtggcacgccatgtgttgcagcacatagcactacccgtgccctatatagttcctatactggtgccctctatcaagtgaaacggggctccgacagcaccacgactaatattgcacctctgtccgctggaggagtcgctaacgctgctacgcaagactcattctgctctgggaccacctgcctgatcaccatcatctatgatcaatccggtcgcggcaatcatctgacccaggcgccccccggaggcttccagggcccagaagccaatgggtatgacaacctagccagcgccactggcgcacccgtcactctcaatggccagaaggcatatggcgttttcgtttctcccggaaccgggtacagaaacaacaacgccaatggtattgccaccggggatgccgccgaggggatgtactcgatcctggacggcacacactataactccggatgctgcttcgactatggcaatgccgagaccagcagcaaagacactggaaacgggcacatggaagcaatctattgtatgatttttcccgtttcttcactcctatgataatgctaacgcttactagtcggaacgagcacggcttggggcagtggctccggcaacggcccatggctaatggctgatctagaaaacggattgttctcaggtgtatcttcaggttacaactccggtgacccatccatcacctcgagattctttaccgctgttgtcaagggcggacccaacctgtgggcactccgtggcggaaacgctgcttcaggatcactctccacgtactacagcggcatccgaccaactgcttcgggctataaccccatgagcaaagagggagccatcatcctcggtatcggcggcgacaacagcgtgagcgcccaaggcacctggtacgagggcgtgatgacctcgggctatccctccgatgccactgaaaactctgtccaggcgaacattgttgctgccaagtacgccacaacctctctgacaagtggcactgcactgactgccggaacctccatctcattgcgtgccaccacctcctcaagcaacacacgataccttgctcataccggcactgccgtcaacactcaggttgtcacatcttccagcgccacgactctgaaacaacaggccagctggacagtccgcacgggtctgggaaatagcgcctgcttctccttcgagtcagtcgacacccctggcatttatatccgccactccgatttcaccctttatgtcaacgccaacgacaactcgaaacagttcaaagaagatgccaccttctgcccacagagcggtatcagcgggcagggcagctcgatacggtcttggaactacccgactcgctatatccgccactatagcaacgcaggttacatcgcaagcaacggtggtgtccacacgtgggatagtgccacattgttcaatgatgatgttagctgggtgattagcagcagcttcgcttagagtagcccgatactgaaaagggggctgtagagattctgcctcaggtagtcaatcaatatattatacaaactctgaaggaaagtgaacaaacactcttattccagtcttcacacggttcaatgagcatatagaagtgtgtataggcctgtcttgggttcatattgatctatcaaaacagattttcttctacatgtaaggaaacaaaatgtcgaagatacacattgctcgatcaaacacactccggtgccccatcgaagcaagctctctctcaaccacagtattaaaagacaccaaatccatatcccgaaatcctcaatcctccgtattttaacgaatgcctctgaataaaaggagggacagtcggtgatccagaaagtaacttttcattggcagagtgttcaccagtactccgattgtcaatatgcctggtgattactctaagcggtgcgggtgagggtgacgaagccgctctggaagtcgtcgccggagccgccggtgggagcctcggtagggaagctgccatcaccgccctcaggagtaccagtgggacggtcgccgccgaaagtgccagtaggacgctcaccatcatcgtcgccaccgtggccagcgccgggagtgccggtaggacggccgccaccgaaacccccagtgggagtaccagtagggcgtccgctgtggtggccgtgaccagctccgggagttccagtaggacggctgccgccgaagctgccagtgccagtaggacgctcaccgccgaagtcgccggtaggggtaggccactcgccagactcgtcatcaccaccagactcgtcgtcaccagcgttcttgccgctggattcgctgtcatcgggggagccagtagggaagctaccgccgaagccaccggtgggagtaccagtaggacgtccgctgtggtggccgtggccagctccgggagtgcgagtaggacggctgccgccgaagctgccagtgccggaaggacgctcgccaccgaaaccgccggagggggtagggaactcgccctcatcaccaccctcgtagtcatcctcctggcggcgggagtagtcctcggagtcgtcggagccgccagttgggaagctgccgaagccaccagtaggggtagggaagtcaccaccaccggggaatccagagccactggggaaaccaccgccggggaagccagagggagtagggaagtcaccgccctcaccaccaccggggaagccaggggttgggaagccacctccggggaaaccaccggtaggggttggccagtcaccgccgccggggaaaccgccagtgggagttggccagtctcctccgctggggaaggcaaatgagccagaaggaacgtcaaatggttggtcgtcatcgttctcgtatttgtcgacagatctctttccttggggggcagcccagctgcccgaggcaaagagcagagcaataaggtaagcttgggtccggcccatgatgacggttttcgagtctatcgaagttggtggaaaagaaagaaggtgagtggaaagaatgttcgacttgcgaaacaaagagagtgtgatgaggatgagagtgaagccaagtccaagatcgaagccaagactctgatctttatacacagatcaagaacccctaaagcttggctaaacgaagtgcttatcccggcttggcttttggcgccgggtccgaaccgctccactatctccagacaacggaccagggctagagatgcttgttccccttcggtcgcgaaagctccgtgaagcagtttgggactaaatttcaggaggcctggggcttgaaacactcgcaactcctccgcagcgaatcagcggctccggcaccactcctggaggttgagcccacctgaataaggggttcctgtcaaacatcaactgtgagagttctggcaacgatgaagccgcgtcaatgtgggccgatcgacatcgattgcgcgtccagctaaaaaacatgttttaggccccatttcgtaaaattctttggcgatggtgccttcagacggaggtatgccttcaaaacctcagcccacatagagtttctgtttcagaattacagcaaggcggtttcatgaatacgcccaacaaggtttgtttggctcacgcgcagctctcgaagcttgcaaggggccaacgtgcacacgttgtagtacgaggctggatatcgcgatatcaccaccaataataatctcacgggccctcagtatcggtgatgggcaagtctaggggcattattccgcggtctccgaatccacatcttcagtgttacaccggttttgcatcccggagtcctcttcagcttcactcccaagagcggacatgggcaggccggaacaaagaaggatgatgacgagcgccatcctacacaatcagtcaattgacgccatcgaggttccatcgctccaatcctccccaggctcgcaagttcacgaatgctaagaaatgagatcgacaaggcacaggggtggctcgcacaattttattcatctgccgaataatcttgtttctacatcttacaacggggcgcctggtccgaaagcgcagacatcaatatggctcaagcgccatattttgacaatatcagatagccgactataactgtgattccacctgcatattctagaccattgactatcataaccacatcctgccacacggcgagagtacctccgaagaagaagggaaaatctcagacagctaacgcccatctcatacttgcagcgagtaatggggattacgaatgcttccccactctcgaagctgccagaagcaagggcaggccaccttctaacttagacagacccaacgtttaggtaagagtgctcgagtccagaggtccactgagggaacgagttcccggcttgcgctgatccttcaacgccctccaggtcaacctgggaacaaccgctctgggcgtccttgccgctgaatcgatcctccagccactgaatgtaggtcagtcgagtagctccgacaagcggcgtgtggccgtacccgtccacgaccacgtaagtcaggtggttgtctgggttgatctggcaggtcgcttcgacgctggctgaggtaatatcatgggagataaaaacgtcctgagtcccctgaacgaccatcaacggaccagcgaaatccctccccccggcattccccaatccctcgaatgagcgtgcgtggtacgacccgttgtaccacccaggctttaggaaatcgctagcaggggagttgagaaatagctgctgcgcaacggaggaacttccctggatctcccgtatcaggtcaattctcgcgatggcggccggggtaaaccactgatcgagcgaaaagtcagagaagatgctgcccaggcgcatgccagccatgatagtagcaaatgtcccgacctcccaggccttggtgacgggcgccagggcgaccgtgcccacgtagcctttgatagtgtcgctgagttccttggcgagggacccggccgtcttctggagctgacctacgtactcggctgtcgcccacgccacgcctcctccctggctgtgtcccatgacggcgaatttcccatccaggcggcccttgaatgctgtgcgagcagcctgcaggctaaagattgcgtcgcgcgcacctgatggtccaacaaagtactgatgggggatctctgagccatcccaggactgacccaccccaagacctgcgtaatcaggggctacgactgtgtagccggcctgggcgagccaaaatggcatcatatctccgtactgcagagagcgatatgcagaaggggccgcgtcggcaaagaagcccgaggtgccgtgagtccagaggatgacgggggcaaacgagccattggtcgcagaggggaattgccgagacgcaaagggccagaggacatatgcgcttgctgggacgaccgtgccgttcagagtttcgcttgtatataggatacggctcaaggttgttccaggggaaatggcaaacgggaacgtgtcggccgcttcttggatcttgagcacctcgccaggtttcaactgggaggagttgtgtatcgcagggagtgtgtagaagtcgtcctctctaggtcctccgttggccaaaccggatcggtcagcgtttattaccgtgttgactctgaagacgaggtcgtcggacaggtttgcggcggaaatctgctcgggagtgagagcgaaggatgagttgtagatggtgttgagcagtgcaactggagctgcttggccttggacttgagagggtaagtaactaagagatgcgaatagagctaatccgaacagctttgaagctgagaagttttccatcttgggtagttggatactgatacttgggtagtagtccaaagtcttgcatgtaagtctggttaactggctcacggtactgcgggctggagtcaagataaataggcatcgtcaaaacatctacactacaaacgccagttgaattaataatgttcaccgcttggtaaatgacaaatgctcgtgtggaacttcaactccatgtcgtgagcatcacagattgatcagatagatccctttgtcagattgtccgtccgcagtccgcacgccaagaagatcgtgccttccctttcgcctgggcgagggtgcggggactatcccaaagtggttagtgcccgcacgtgctctccacagccacgcgcagtgagtgcggaaggagcgatgaaaaaaagaggaaggagcgatgagccaagccgcggatttgcagaggctcacgaaagccaagagatttgctaccaaatcgctattttccggcaatgcaaagaatgcttcacgtgggtcatcgtattaagattattcagcagcaagttgattgatttgcgcttttgggcgaaatggtggtcatatgtcatttgcccgggtttgcgatccaagacagaacattaaaatgaaaacctcaaccgtagacacagcattttttgcccatacttcactcggaattgaacaaaatttcaaatagtttttgatcgcgctagtagacctaaattaagcccaatagattgactaatcatgtcccccaactacattacaagcgtatggcacaatctgtgcgtacaggtctagggtagtgcttagaaattcaacccgtcatcatgttttgcgagtctatcatgcacattcccgctgatcccgatgaacatcccgcatcatgagcagagcctcaggccccaaagcatgcaaagcatgcgccgtcgcaaagcgcaagtgcggaaggcagaaaccgcaatgcctccgctgcagacgcctcaatgtcccctgcctataccctccgtcgaaaccaagctcctacgtcctcatcgccgatgacgaggatgtggtcaccattgagagcgacagtagcgcgacggcggcgacatcgcgggaatcgcggtctaccacggcggtgtcaaccttgccccagccgcacagattcgaccccgccaacttctacctggccttggacctgcaggactccctcacccacgatgagcaggatcttcgcgcctcggcgccgccctcgtggttccaaaatatcccaggcgaccttggcgtgcttctccccatccagaaagcggaccttgatccatccgcgtttgataacatgaagcatcacgtggcaatagccaaggagtggctcgcccgctgggtggacagagggagcaaccctttcatccatccgcagctgtataaacgacggctgcccacgtgcgtgcaagacgcgtacacatccgtggcgtcttacctgcgtaagaatgaggcaaacgagcagatgatataccggataattgaagacagggtaaggactctcgtcgagtcccatccaaaggacccgtctgtgctcgacccgattgattccctcggtcgtgtccaggctttgctgatctaccaggtcatcgggctgtttgatggcgatctccgtctgcgacatgtagctgagggttacatccagacgctgtatgaatgggctgccagcctggagcctcttgctcggtatccgctgtggctgggtgatttgaatggcacgtcgggcacacatgtgtcgacgaccggcgtgtacgaggcgtcagatgtgggctcgtcgaccgacggctcttggatgtcgtggatcatcgccgagagcatgaatcggacatggacgcttgtagctggtatccagggagtgtacaaaatgatccagcagtctcggagccaccgttgttctgtggtggggatgatgatgaccgcccgcaaagggttgtgggatgcgccgtcggcccctgcttgggacagaatctgtgcggagcggtatattgggttcatatttctatcagaggttgagacgttgttcaccaagttcacgtatgatgaagtggatgaattcactataatgactttgggtaccatgttcgggatcgagagaatcgaaaggtggaggctgaggccggctgtcttttagcatgcttggaatatgatgtttgctctatcattaaattataaaggggtatcggtatatagaaaaatgaaacccataacgcgctcccatgacttgaacggttcataagctcgtagacattcaataaacgctacccaaactccagatcatgatgatgataaccctagctcgaaagtccattatgcgtcgcctcaagcaccagctcgatgtgctgcatgcagaaggcctccctctctcgcgtggcgaacagcacggcgaactttgccacgttcttgatctgtctgccgttcatctcgatggctcgaagtttcgcaaagtcgtcatttgacaaggtgttggcttgcccgagactccagatgagctgcttccagatgttctccctgaaactggcattcaaatcgggatagttgagcctgagattgatccggctctgcatcgcactatcgatggcttctggatggttggatgtcaagaacatgaggcccttgtagaaatcgaaaagactgtagtctgttagaattgactgcctagagataggcgggaagtacgagggagcaagacttaccgaagtgccacgccgacgatggctctgtcctggagaaagccatcgcaatcttccagcagcaggatggcgtcccatttctccgaaagctccagcaccatctgaagcctctcctcgaccgccttggcgttctctcccaattctgcggcactcagcctgtagagcggcctacgcgtgtgctctgccactgcctcgactgtgaaactcttgcccgtcccggggcgtcccgccagcaagatgttcaggcccagccccctgctctgctccagctcctttgtctggggcatgttgccctcctggccatggacgaacgagagcattagagtcttgtacccctctgggagtagcagagtcgagaacacttcgtcgtcccattcgatgtccttgacgctctccacctcgaatttcgcccatcggttcagctccaggaagaatccgtgaacggttgcggaacacagcattagctgatcgtctgtgagatcttgacctagaatattcatgtaagtatccgactacgcctcacggattcttctgccaaatggctatgcgtactttttctgtttaaactccgtctcgccttgatcttgctcgccaccttgtcgaattgaatatccccctctagcgcattgatcatggtctgggccgagatttgggcgggacgaacatgctcgtaatcgccgacgtcgatgtccggcatgattgctccagccgtcaatgccaccagctccgtatcttttccggtctctcgcatgtaagccaccttgtctagcacaatgcggcccttcatctaaatggcggcgtcgttagcggatgaatttatttgtaatttctgaagggaggaaaaaatacatacgctcttcgttactttgcgtcgaccgacggtgtatttcaccaggccgtcgtacgccttgtgctggtgccccaggccgagtgtctggaacttcttcccgcgcgcgatggcctgtagctcaagctccttcttcaagggatggaacgaggcgggaaacacctccagctcggcgatgtgccgcgtcccggcgaacttgtccacgcggagcgtcttgttggcgtacccgaagctcgtgccgtcccagtcgacgtacttggcatggatctccatatgcgactccttgtaatcgcagtagttgatgacgaagaactcgtgcacgccgtccttggtcgagacggcgcgctccccgggctggaagatggcccagagcctccggtacgtgatggacttgttggccagcagcagctcgacctcggtcatgtccttctgcagctcctcgagcagcaggtcgtgcagcagctgcgagtacgtggccggggcgggctgcggcgaccgctgctggcgctcgaggatctcagtgaagcgcgcccagcggaagtagaaggggtggaagggcgccttgaagacaaacttcttcatcgacggcttcatgcccttgtagccctcgaagacctcgcgcaccgtctgcttgaggctcgcgttctggatcaccaccgagtcgagcgacatggtgcgcccctcgctgtagttcttgcgcatgcgcgccaccagcgccttgttctcctcctcgagcgacgcgcccgggtcgacggaccagttgcggcagcagtggcatgtctgcggtgcctcgtacagcgtctggatcaggacctgcgacgtctcgggcgcctcgtcgatgggcgggcgaccgaaaaaactcatcttggtgccccgcgggagcggactgagaaccaccatttattgcgttcggttgtcgtgcgatgtttctgttcggttcggttcggttgctgtgtgtgaattgatgcttctctttgcttgctgttggttatttgacgattacccagcaacgaagaaccgtcggcgacaggcaggatcgtctagggaatatatatcagtgcgagctgcatctcctttgaggaacgggagggccgcataattaaaaaatattggagaccgtcagtcaacgcaaccactttaacttggagcccggtcaggggcccttggcggcactgggcgcgtcagcacacgctcgtgcctgtcacgagccgtgaagatccttgcaggctgcttctgggcgccgtttgtgagagggagaggcagcgtaagctgaggatttagtgctccgccaagtctgctggtagagccagatgccacatatatccttgcattgccgtgatgtcagtcgaacagggcctcatttcattcaaggctagagcgagatgtgtcgcgtgtgtcttctcggcaattcgcaactcgcatgaaccgattaatatatggctttcatgccgagtcgtccctttgaccactaccatcgccatgatcgaatggtgacactttgtgctcgcgccccctgtcagaaggacacgctccagtttctatttatagacctggcggatgcgctgtgacaagctctacagagcaaactcaatctttgctgcccacctcttgtgactatttctgcaatggatcaatccattgatgccctacagtatctcatggatctctgccatgtctcaccaatcttctcttacacggatcaaacaagcggcaacaacgctggccttcctggaggactgagtaatgacataaatcagcgctgtcccacttgttccaatgatggctatcggcagtcagacacagggttagagtgttcttcgatccgatcccggccctagacctgtctggggtcatatctggttggcctcctgcatgcttccttgtcaactagccaatcgatgcggaagcaagatccgggatggtctgagggccacgctgctttacgattggaggctgcaaactttgattccatttggacatgtaatctgaggcaacgtgtcctactgactgggatgaagatgtgccggcgatcacactactctgaataggacgaatatggaaagcagcatcacttgtgtttgttattttcctagtcctctccttgcctgcaccccgccattccaccgtatcgagacatcacaatggtcggaaatatataattgccagatttcaccgattatttctttccgctgtcattgctgctgccactgccgctgccggcaggggtgtacgtagagccgcccgaaccattgttgtaataggtgctgccattggggttcgagtaatagtaggatccatcactacgccgattagcatcagctacagactagtcctagaacacatggaacttacgtgttcgagtagtggtaagagttctggttggaggcgctggagccataatcacgggcgcagtagtgattgccctggacagagttcagcatgttaggctggacattgcgcacaccagcgctgtgacttttacctgtgagttggtgccggagctcttatattcgtaaccggaaggcatcttgaaggttaagcgacggtgttggtatctggtagattggtgtagtgggtagattgaaaaaatggatgtgaacgaaaggaggagaagatgaatgcttgagttcgatggaaagagcgatgcttttataccctcagtctcatccctgactgtcctttgcatcttatctggtagatctaccccgcttcacgttgctttctctgaaatgttgataatgccttgattggcagataatggtgtcaccacaagccgctgacgtaaatcaggatgcagtctcgcccatcctgattcgcctatagtatgactagaagcctaaagtttgcctaatcatacacaaatcgtacaagctttcgaaaacatgggccggcagttgagatagtgcaagttccgagcggactctatcctctcaccgctgttcttatggaccctgcctgctatgttttgaatagtcttgtgattgacttaaccctcaccctttgtcgaatgttggctttcttttgctccgctaatttggccaatatgctatcacctgaaccagacctggcctgatgcctggctgctcagcgtcaattgcaatagttgaaactgatggcacctgtgacgcatctacaagtgagcgatggctctttctattgattttcaatcatatggttttaatgatatgatgtttatgttgttatatgttcgctcactgtgttggctttcattgtattttgaaggtttaaaggttgtttttactggcgctatcctctattgaagcctgatttctttccaggtgaaagagggtggcttaaatagtcatttgacgagcagctcgtcctgacggcaagtgagtcatcggcatgaaggtttatagaattctcttccgcatgactgcagcttgggctagcgaaggtttttacctttctattcattatgttgagttgttgggttctggcatcttccattgctgtttaactttatactcaaactttctcccgtatgctggtatatgtctgtcttatgtatcttgaacttggcggtcgcctcgtcattggaaataagaaatagattctacgtctattgctaaatcgtaatatttcaacatgccatagatctacgcgtactcgtgccatccttcaatcgaacccttcgtttccaacccaagcgcccattggatgaggtcaacagtgacatcgtcgctctgcttcgaaaatggcaaatccacccaacgtctgaacccatgagggaccccagggaatatatgaacgctcgtagaagtcctatgcaaagagcaaactttaggttagtacgcccatgagtaacgcatgccgagggaattgtgtcagagataagaaaacctactttagagcttccagtcgcttggcgaagatcaaaccatcgtctctcaacggatccattccagctatgatgaaccctgtctttggccaaccttccaactcggagtctgggcgaagggctgcactgatcctggggtctgcactgtcttccatcttcaataaattgacgaacagttgtagcctgggccacggaagcacaggggcatcacggcactgccggctcgaggctttctcgggtgattccatcagatgcaacggggtatggtcgccgtgaataagccatgggatagagagaactgctccagaaaccaggcgcctgtgagacgggtctgcctttgcgcgcgtcacgtcgtgctggacaaattctgcggcgagattggctccggccgagatacccaagactgctagctgtccagatgaagcatcgatgccatataaaacggaattcccgctgatatggttatacacgtccacggcatcatcgtgagccacggggaagacatgctgaggcgtatggctgtaattgacgctatacactgagatccctgcttcaagggcaaatttggcgcagagaggatcttccgacgtctctgtgccaaaaagaaacccgccaccatggaagtaaatgagcgatcgctgatttccagtgccttcatcccccactcgggacgcgtctctcttgggagtatatcgccgtatggggattgaatttccatgcctcgacggcacgatagttgttgagatgtctagccgggattcgaatcccgattctgcaaagactttggcgctggccttgtctcgaaacgagtttaccgcttgctgaagctccaacgcagttgatgggtcatttccacttgatccttcttcggcagcgctgggatttgccgcaacaaacgcgagccactgagggcttgggtgtccgtattttgaaaaatccatcggggcttctttgatccaagacaaagctgaagctccgtgtccaaactggaatattttagatcaatggttggattggcggctctcggatcgaggttcacaacgctgcatgagacaaaagtaataagtaatggtgccatctggatcctcggcttaaccgccggactgagacccagaacccctcttttcgcttcgtgttggtctctacgcggaatggagctaactggacattaatgtccggggagaatttcccgcatttataagacagggtaacttgccgaggaacgctattgtgcctatcatacattctattcaggataaaagcaggaactatttgacgtgcgaatggtatttattcaaggtctaacggcaactcaattttgtggaaatcagggcggatgtatgtacaatgcttactctataaacgagccgatctaccacccacggtgtctaaagtctggcccgttctgatggtgtctgcttggactgaccgacaactcggaaaaatgtctcttcgacatcatgttctgagagccagtttgtgttcggtcttccctttaccttggtctgtaggctcttctcagcatcctcatctgatgaatatactggcttcttcgctccaagctggccatggacaatctctaggagccgagtagtgtgaggtctccgcacactgtcgtatagttggatcgcttgtttgattgccgacgcgcttatggggcctggcgagctgatccgtggtagaatgacatgcttgaaggccaaggccagggcgagggaatcatccagcgccaacgaccctccagcagcaaaagagccgccgtgagtgtgggcagcatctccgaccaatgtggcgcggtctgatatcacccaagaagggagcgcatcacccacatagttggggtagagccgaatgtatggtgtaagctccgacagcgccttgactgtcggattccagttctgtgaagctcggggttagtcaagcctgagtgtttgtgtgttggcatttgctaccttgtatttctccttgaaccagctgacatcatctgcctggttccaggcaactgccttgtcgatttcttcggtgcttctggggtcatcaaatgacccaactgtcgtaaactgaccctttcctatgccgaagaattagtctgaatgaatttgaaatacactctaagcggcgtctgcgacgtaccaagcttcgaggcaaagaagtgatcgttcagaccccactgtcacagcatcattagttagtttagactccggaagtagtaccgatattggtgagatgttacccaatgaatggcatcctcgggcagatctggtaccttgccttcaaggatagatgcatcgaaagtggcgcgagcaaaggtcttcccactgtattttagtttgtgctctgggacaaaggcctgcctgactttctaaaactgtattagcgacatctatcgagatgaattcttaggacatacggatttgatgccgtcggcgccaattagaacgtgtcctcgcgcctctgtcccgtcctcgaatgagagagtaacgccgtcggcatcagatttcgcaccaacagtcttctttcccaaatggatattgcttgtcggtacgtgcttcaacagggctgcgtgaatgtggcctcgatgaaaccgggttgtctggtgtcgaggatccgagacgctggtgtatgtgtcgacggatacgacctggtttgatttccagtggcttcaagcatagtttagcatcggatacaaactggtctttatagacattaaatggcgagtatggaataccgtatgatttggggaatcccgcttgtgcctctgaacccagcgtcgtcatcaaaagcgttggtcacgccaagcttttccaaggttctcatgccctgttataccgttgtaagtctcgaataatagacagacaagattgcgtagcttgttccgcacttacattggggctcaaggcgatacttgctccgatttcgagaagctcgtcggcttgttcgtagagctggatgtccagattcgggataccggaaatacgagagagcgccacggctgttgccagacctccaatgccagccccagcaatgagcacacggaagggttcctgagtgttagccatgttgtatcgcgaggcgttggaatgtgtgtcgtcgttggtcgcacggtgtgtctgagatgcccctgaccagaacaccatcgtacccttatagaatcatacgcactgccggatccagggccgacttcgctcgccgatatttggatgaaccaataacagagcgactgccgccagtctcgggacggcgctggtgtgtgattggcttggtgttgagcacgtcaccatcacgcaaccgcatttgtcaccaaataccagcttcctccgccccgacatcgagtgtccggccccgtctcttctcctgacccattctccagactcgaattggccgtcaggaaccggtggcagacgccgacatcagcccacaattgaagggtagtcggcctctgtgcgacatggcgacaaacatgggttcaattgcgctattaacgaacacacgcgataattggatccatataaagtctgcaggtctagccacgtctatttgtttgccatgggaatgttcgaaatggtactgaagagaggtttacgaccccgtgtgctgaatttattcgggattgaatgatacaacaaccgctgcctcgcagtaacagattatcgcaccgggatggcttctatcacgataactcccgccatttagaggaccgacttggaaagaatggttcaggaggtgaaaatcgaaagaaaacaacgtcctgtcatgggaacctagattcgatgcgagtccggaaaccaccaccgcgaactgggctacccggcctccagaaccctgtgacctatcgaattgttccgtcctaaatgctcaaggtattgatgtatcgatggcgagcaagaaaggctttactctgctacaactcagtcttggattgttacaacatgccagaacttgtgacccatattccgatggcgatggattcatttgagaacaggaagaacggagagtacgatgaaagagacaatttaccaggggtgaaagattcgtgtatcgtagctcgagctttctcgcccgtggtatcattcattcggcgccataagaatataaccgtatttgccccagattggccaggcgacacacggctgtcttcatcttcgaaaccgttactgtcggttgaccgaggcaaaagactccacgaacggcaaccagccctagggaccccgcctccaagtacaagtatgctttcgcatttaagaacggtatttgtaaaacgaacgttagctgaagtgtttcatggaaatgaaactcgagacctggttcctgcatactaataacgtcatgttttttctgaagaattgctagatatcctagattagaactgacattggttctcattttatacgatggtgtatattatctaggcagtatttctggataggagagcacggagagaatcttgtgataccaagtgagaacagaacatactgttcgatagttcaaccataataaaaatcaataccgttactgctaattgtggcttgacctagatatcttgaaagagaatccttccgggcaagtcttgactctcctcacacgattcaattccttagttctagataattttagcagcatcttatctatcaaacccttagatctagaaagattcctgccaaggatcatctttcttggcaagctgtaggaaaacttcttggtaggggagttgtggggggggctgcagcttggcgatccatgacaaatgtccgatcgacttcagatggaggcgcatgttgttcatatttgggtccggaagttaatatataatcccttgtgaatttcccaaatagtccttacgacccagataatttacgtaagctgcaattcttttcagccttattcatccctaagaactagccctgacagtgttattgacggcatgttcaagtcacagtttctcccgaggctgtgctctctattaggaagggaatgcgtgccacagtttctataaacatcaagaatgaaacaaagcaatggcaatgcattcaaatgcgccaaccatgcgatctattataataaaagggatattacgaacgctataatcgcttgcctttcccaaccaccacacctaccaactatccagtcgccaatattgggtatcaacaaactattcgaaacaatgcaattagagaccattgctcttgcatgtaaaaactcccccgacggtgcctgcctcgaactggtcgatgataccttgcacactgacataggtaccgagagtgaggaacaaaacaccgatcaaaacgataatggcgttgaagactactgagacgtaatctagaatgcggtttcgctcgaggccgaccttccggtcggcattgcgcatgcggaagtaggcgagggcccagaaaatgaagccgaaccagcagttgaagagggaggacatgacagaaagaactattttgagagtgagcgatattcagagcaacgattcacatgatgggggattttccacgtacgggaggagaagaatgggatgacctccgcaatgatgaatgaggcgatccaactaacgagtaggacacctccccagtagagccaacccttgatggtgtgttctgtgagatgcttcgagtcctgaaacatgcggaagaagacgaagcgtccagagacggaagcatacaggcatcccacgaaaatgatggtggggaccatgaaggagtatgaaaccttcttgtaggtgtcggtcagaacaccaaaagcaggagcagtcatgtactgctccccagtgtaaacgtagatgatggaaccgacgatggaaaatgtgacgatttcagcaatggtgcaagcccaaagagccttagggaaatcgctataatatttgtcagtatctgagcgtagcaaagagatcatgaggaataagaacataccgaggctcacgcatctctgcgatgaaactggggagggtggtctggccaatgaaggtgtagctcatattcatgaacgcggacatgcccgaaacaagagtcgtagtgctgggtgtccaagcagaccaggaaggttcacccaatgaaggatagccagcgggctttccctggacaccggaaaagacggtagccaggaaaacggagatgaacgtgaagaaggcggatccgaagcccagcttggacaacatctcgaatgttcggggcagggagccgagccagctcagggcggtgacgacaacggcgaaagcaaccgttcggcatgcgtggatcgtatcggcctcggtcatggtgttcaggtacatcgctccgacaagaacgtgaagagcttggatgaaggtgttgttgagcaagaacatggatgcagtccaccaccaagcccaacgcttgttccaccagagcatctgaccaatatcactgacatccttgacctcgggatgtctcaggcagaattcccacacaatgagactagtgtagagcaccaggccggcgcacacgacggtgaggatcagcccggggacgaggccgagcagtgagtagctccatgggaacgacatgatggagagcacgatgtattcactgaacagcaaaccggccgtcttctgccagctgcaggtcctgtactgaatcccatttccttcttctgaagcaagctgctttcctacaatgtcattggcggagtcggtttcgatctcggaggagacgttcttgagcaaatgggtcgcgacaggctcaatacggggaccaatcacgacattggggccgccaaaagcagaggagaaccaactgccggagggctggggcctaaccggctcgaatgaagggtcctccgactcgaggggggatttggagtctgccatggtaagactggatgggcgcaggctccgacgattttaccgtgcggtggaataataacaggacggtgtagacaggaaaactcgacaaactttcacaagcccgagcctaaaaacaaacgttgagcagccgcgacttcttataattccagcgatcgcttccagaagcgggtagtgattgccactcgaaaaggttcatcccacgcgtcgattcaggagacccgccctggaatagcggttacattggcaggatccacggagaaacgcgtacataaggtgtttgcttgccgcctgagcatgcagccttgtgtgctctgcgttcctccagcccgctccattgcgtgcgtgctgccgtggctcgcagtccccgattgcgcaatcgaccctcttccctcgcaaggagccgagctgatctggggatgtttgatgatgtcgaaccactgactgggagaaagctctgctggttgggatttccatccatcgtcagcgttggtcagagaaactctgattggatcgccatggccgagctggaaacgggtagtggggagagtcatgggccgggtcttttattagattcgcctcgggccttgatgctggccatggcgtgcttgcaggagctgcagcgggctctctttctgggcatgacaaagatcgatctccatgttgtgttgggacgggatcaactgggcagagacttctacgccaaggcagggtggccgttgtcccgaagtgcaaaacgctacgttaactactttgctggaaatagatcatcagatcagcggcgtctctttgttctggctcagcttgacacatataaacgtgccgccccggccttagcgaagtggctgcatggcgttccgttcagatgtactttctaagtcatcttcaacatcagatgcggtggcacctcgcccagcatcgcccttggcccccatacagcaatttctgtgaaaattggccacgagattcagcggaagacggcacgtttctgtctgagagcattgccagttgcattcaggccagccattcaagtttcacagtcgtcaacagggtttgccagtacgccatcgatacctgtaatcacgcaatcgagaacccggatctgtcggcaatcatggtgtgaagaaatgctccactcgtgggttttagggaatgctttttgtgcataatactgcataataaatcttagctagtggtctgctctccataaactccccgcagtccagccatccggtgaaccttgccttggctcagattgtgtgccatatttgaatattcccgatgggcgtagtggaattggaaataagtttttaagcttggttccagtaaactcggcttgcatccgatccttcgaaagagcgcgctggtttcagccagaacccacatggtcaagatgacatggactgactgagcctgggattgtcacgtcgtctttttgatttattgatttcaacccccgttcatacagagaaaagtcttccatgcttatgactagacggattcgtcgtcgtgatctcatttctggtcaaccttgagccttttcccatcaagctgctttcaagtcaccgtcctctacgtcaatcttacaaagacacgtcactgacaggaagcttaacggactaacgtcggcgtggctggatctgaggctaaattgttggcaaaggggtttagtgtttctcttgccttaggctgatctgctcatagcgttgacatcttagtgtgccacttccctgactcaaatccacttgtacaggcgaagtacttcaaacgaaaaaggaagttgaattgcaagtcacgaagctcgggagcgtaaggtcctttgagaccggggtgcgcgagaggcctccaccttgtcatgcaatcatccaactcacatgggataatttcaacaattatttcgtagatacaaagaccacgcttcctcacgacaaagatcactacgcagagtcttgttcaatgtcttggattcgtagcttcatcatggagtcgtcatgaggtgaagtaggcctgtgatagatacgaatcttgaaagaaatggtattctcctgtccattgccggaactccggacacgtacaatggcgcttgtttccagcgcaggacaaacctgctatactttgccttcagtgtaactaatctcaaccactgtccctaatccattcgttctttgtctggcgcgactaggttaggccatcagccgtggaggcctgtagaaccgttacacgatggcttttagtcgcagcaattgtgaagatggcgaattcgtctggagaagaacctcagcagccggaaatcttgcaccatctcagtttatacacacttcctccttctgcgcaatacccagaaaatactctgctggtgacctgctcaaccgactcagagccgatggtttaatcgggaaaccgaccctatcaaattgggagttaatgagcattagcctgtcggtcattgtcgttatgcccatcattttacacctgaccgctttggaatagcaaaatctgggttgctgatgatcctattgcgtctctatattgcgctctagatctacagacgtccgtacctgtcaagtgggtgaaataaaacatggcacaccaagctcttttcgcgtaaggcagggacctcattttcactaaacacaataataagagaataataaattatcctatgacatttagcttgatatcatattcagtaatggattaagttctaatattatgttgaaattcaacgctgaactgtttcgatgtgctttatttcacccacttgcctgtcaattttcgggtttcccctacctctccctcagtttcctatccccaacccaaatgtctaggcgacagcgaagccattaatacactcctcagagcgaagaactgcttttacttcgttgttttattctgtcggacaaatgaatgagagacatgtttacgcttccttgatgttatcaccacgtataacataccgatacaaacctccaacgctatggattcccattcaaatctcgacctcgtcagttgccaatctgccaatatactccatggatggcttcttcactcagaaaaatggacacgacgtcccaaacccacctcgtccagactgtatcccatcgaggcgacaacgccgcagggatcctacatagtgtgaagatctctgtatcttgtggtcctttgaagtatatgatcgtagctaaacaccgtatgatgagaatagaaagggtgattaattaccagcattgaataataacctcctacatctctccttcaatcctagctcagcatacacctcaacaaggcatcgcaatgttagcgaacggccaactaaccaagttctagtctagcttgacagttaccttatatacctaggtttttcttctcactagctagcatcatcaggcctaggatactaagatctatgacttagagagtcagaagactttgggcttcatatctaggtagacaagttcacttataggtcactcccacctagaagaagttaaggtagtgacgcgctatatgttcgagctagatcaccttcttcgtgatatagccgctcccctagtaggcgatgttacctatcagttagctagatccctgcctaatggttgagagaagtcagattttctcaatactaggtcggagttaactaaagcagcatcagagatattcaggggctacattcggaagttcaagatcagcataccatctactggctatatagtctgaccaagagttcaggttcaaatatatacccagctagtcgtaagaataaaggggtagtgatacctagctaaacctccttcctagcgcggtaaaatctcgcaaaaggctgcagagcacagtgcgcaactccgtgatggtctcttgagactttaggggaagtattggtacatcagcaagacaagctgttgctgccgggctctgcagcttagcttatcctgaaatgccattagcttaccaggacaggaggtgcattcggctttgcgcctccagtcaccataacacacaaggagatcaacgcgggattgattttgtctgactaggcactccaacgagttccagaatagcgtacactattcagcaagctcaactagagaaaaactagacgtcaggattctcgattcacttggccatgagagtggaatacacgtaatctagaagagtagtgaaataaagatgcttttgtgatctatgcttcaataataaacatattttcttcggcaccgcccaagtaaccgtacaacttcatgcccaaacgaactctcgtcgatcttgggactcttgatcaatcgctgctgctgctgctatagctacaatatcccgccttctgccccccataagtctgaaatgagcattggtaccgatcgaaaccaggaaaccatacacttactgatgaacaagtcatgctctggaattcacgccaacctgccagccgtggcgctcaatgctagaaatttcggaggaattattttgatcatatcatagccgttttgtgcgttttggcaaggtgattttgctgaattgtaattgggaggttggttgtttgatcttgagggtacaagattatggttaatgaagaattgactaaggtagagttgtcgtcgacacaagagagtgttgtcacagggggtcgcttataccctgcctcgatccccatgaaacgcatacggtggcggctgcagttcaactggcgggagagtcgtgccagtgactctgccttgctcttcagatgatgctcccagtattgtgtgctgcttccgccgacgcggtatcaccaggacaattctccgacgacagcaaagacagcatataaaggaaattaaaaaactaccgatacatatgattgctagtttcaattcgaaggaaagttgcacagccattatgccgcgtgtgagtgtaccgttgaagccaacttcagacgggtgcgccagtaagtgagagaaatctgcaaccgaatgttggatgagagtatattctggcagaggaagaaagcctggattgcgcgggctctggcattttataccaaaccagcatcacggcgtgtcttattcgtgaactgtgtcatatcgtcgggcggaatttcatattgagttttactgacagtggcgcgccacaatcatgccgaataaactcatgactcgtcaagtctagaattcaattatcacgctgcgttggccctgacaaataaaaagagcggtttggcgcaaactgggttcatttgccacgctcaagtttctacaattgaaggttatcgagtcatatgagcaacagcctttggtggctctgaagtttgaccggatagttccagtcggcttccattgttgggcgacaaggtgcacactctaaatttatggttagtatgaactgtgttttctatgccagggatgggtttaacatcgcagctgtgttcctattgtgttggatcaagcttattcccctttgttatagcatctcactgcatgatcgagtattgaaacgacatcatatatacatctcattttggtcttcctatataagggcaacactatatacatttaacccaacatcatttactggccaccgatgtagatggtgagaaggttaggcgagccatgggaaacagaaccctcagcattctcgctcccggtggggttgacatcatcataagggaaggcgtatcccttgccgtcaatctcgtacttgtgcaccaagcggccgtagtggttggatgggttcacagagtagtaggtgctctgtgggaggcttggctggacgttgccgcccgccaggagaagagtgctacggacgaaagcagagcagagacgggggatgacgcgaacatgctgttcgttgtcgctcgcctgcctaccaaagggaccgctgttgcagccccagatatcgagagcagtgggcttggggtaggcgcggttgtcaccgccgtcgcaggtcatttggtttccagacacgcggcaattcagcttgccgaatccactctgggtatcgatgatcagattctcgttgctgtacttgctccagacctggttgatgtagttatcccagtacgtaccgaacccgttggggttggtcacggaatatgagttgggggagatgactcggatgaggccgccagagttggactggcaaagggcagcccagggagctccatcctgggcctgctgggccgagagatcgctgcaagcagaattgacggaattggccttgagaccgtatgcagtctgggcggaaccaccgttgacatcgagtttcattccaaggggaagacccatgaagtccacatagctaatgttggcaaacaagctaccatcagggttgagtgtaagctcgacaaatccccaattgagcttagagctggggtctgttgggttcttctcgtcaggctggactaggccttctccgatatcagtcttgacaacaccaaagttcaagtcgccaacagagaagtaaatacgtgtcgagtgcatggcaatggggattctcatggtagccacttggccggcggcgacggggatcttgacgtttgtggtgatgggcacagggacggctgagccgcccgagcttgggtaaacaaggctaccgtcctgacgaacaaagacaacagccgagttggagtcatatccgactacgtaggcgttgacagcgctgccaaagttgttggtgaactgcagagggagtgtggcgacaacagcatcgactgcctggatggactgctggtccgattcggtgggagggcgagtgatgagctcgtctccggtgtgagtgccgttcagagtgttgtctttagtgatgacaacctctgtgatgtcaacgggagacacttctgtgaagccgttgttgtctcgaatcaggttctttgtgatgtcgatgctgattggcttggcagaagcagtggctgtgaagccgaccaaagccgacagaagcgtggggaaccgcatggtagattcaacaagatgtggacagtaggaaggattgactatgatccacgttcaacaaggtggtcaaggaatgtgttcctgttgatgcgggttgagatgagaaactctcgaggaggccgcggtgttttaatactaaagcctgactgaatgaaatcattctacattctcccatctcatgacagcgtttcattcgagcccatttcatcattgccctactcaagaagcccccgcctagcataaaacacctgaccttctatctgattgagattcctgatagagtaatgtgacgttactagggtcaatggaaagctgacgttggtggccaatggataaaccctcaaatctcaagccaggatgtgagcaggccgtagagagtgaccgctatgtgagactccggcgcagtaatggtaggtcagccttacacgctgaacatcatcccagactggccgaggactggtattacgtgtggccgaacctggttcccattggcagccttgacaggaataaagtggaaggtaatcaggaacaccctcgtggcctcctagacaaactaggaaagtgaccttcaatggcatgatgggggtcacaccagttccatctatgcaccccaccctgacaatgggcgaataatagaagaggccgttggcctgttcaggcagttcggagatatcgcgggcgatccaaagttggttcatcccatcacccctgaatctctctatggttatgttagtccttgaaggaagaggtgtgaaacaagaataagtaagcggcagaagaagtgcggggatagcagttaatccgtggcttcaaggattgtagctatcgcgcgcggcatatcaatgacgaggggtatgctaccctgatcatcatgctagccctcgtagatcatacgacgtggttgaaattttatgggacttataatgggactcaaaacaaacaccaacaaacaaagaatgataaattccgacccagtccggccaagcctccaggcggagacccggagtctgactcaggggacaactcgtgaaaggtgtcatctcccaacactctccttatagctctgtctctagactgagcatggatataattcaaggaaaactcccttgttttgacatgatcgtttaatatgaatcaaccaggatggggattcagcaacgaactgattttggaatcttgaggaaccacaactacggagttcaggccatgatcgaaactgcccctggctagcgatctggcccccatcatcgcacgtggagtttcgacttcggcccatttaggagcgctacttttggcttgcgcccaaagttgatcatcgtgcatattccatcagtgtagacggaaccagcttccccagactaaccgccaaggagggggtcgggccgatatcgtacaaggacctatcacacagaaggattccctcgtgacattattacctgcataccgagggcagatgttgcccttaaataaactccttggttactaacagaggcaaatgccgtcactagtccacacatctgatataacaacaacggcaaccctcagcagaatttgcttaccaacaaaatctagaacccgccgattggagatgagcatgttacccgcagtggattaggtgcaggtaggctgcacatcgtatgtcaaggattcgggcaaagcgcgtatgtttgtaaatttactaggtcgcccttaacttgctcacaacggcacatctctccagtcttaccacaactcatttctacaacgtgacattgccttgatcttagctctatgggtcggcgagctgccatcttgccaatagcgtaatgtttgataacggcgattaagcaaacgaatccattctgtaggctaccccaatcttcccaatacatacaggaaactatggcaaagagactggcgtgatgtcttcatagatctgagataagtctaaccgaaacatcaagaagcatatgaacaggaagaatttcgtgcacagttaattttcctctgtatttcttttgctctcattcccattttccatttgctttgcacccatgcaatgaatccgggaagcttcagatcagacctagatatccctcttccatgctatttaggaaggaaagccagccaggatagcccaaacagctagaagggagctattttgagctacatgcgacttggctacctcacacaggtgtgaagccttcctcttctattcactgtcctttcgaaagtatatttcttgcagaaaatccttcaattcctcaggcggttcaggcgcattcggatttcttccactgaaacgtatttcgcgcagcaatttggtatagtacatgttaagcaagaaagcttcaaaatccgtttcttccagccagcattcgtggttgggatagaagcgtgtctctggcttctcacattctgggccatagacaacgctgcctcggggtgcattcggcttaagctgagagagcacacaatagtgcccgtccttccctggctcaaggtacaaccctgtctgtgccctcggttgactgttgtcgtagtagaagggaaggaaatagcccccccggtcctctaccagcagcggttcctggaggcgaaaccccatcctgttagcatgactatatgtccatattcgcttcaccagccccgggtcacggatgaacttgaggaagattggcgggatggtaattccaacgagctctgcagccttgagaaggtcattgtaggtcgagtcccagtcctcagtgggcggcgagtgctcaaacacgcggttcatccgtgaagtcatctccggattgagaggtttcagccaactcaaatccccacgaaggacaagagtgtccaaggcatcagcgatctccggctggctgcggacgaccgcctttagggagatctgaagaggcaggcgagtttttgaggtattgagatagttcacagcgtcgtcagtggagatgttggagatcattccgaaccgtgctatgaaccgagctttctccctccgtttctggagaacaggctcgagtatggggaggcaaacgtcggtgaaggtgtgcgtgaaggttttggcgacccgctcaatggtcagaatgtgcagaaaggaaaggatatggaggaggacctccgtcgggaggtcttttatcatagccatgactgatttcaagtgcaggcttatcagatttggattgagatttgaattttcgctcttctcttgtagactggctctgctccgtgagagaaagaaaaaaagaagagagaggaaaaaggaaaagatagatttatgaggtgagacgatttacggctgaagcctggtggctgcaatattacgtcaacaactgagacatacatgcatttcccctcatctttgtgcttttcttacatactcaagatagttaacttaacataattcttaagaagaaaatagtacatttgtggagaaaaatagcgaaattacctttgtgccatccgtaaaagaaacggttcaagttttatggaagtctatcttagtcgagtggtgagtcgtaatataagtggaaaattgtgtcacgtaatactttgcaaaaagctagaaataaggaaccaataaagataaatgatgtgaaatgacgaaataattcttatcaagaaataaggcgcgagctttactgcaaagctcttatatcaagtcttaatacctcggtgaaagtcacacaactggttgatatagggtaggcagaatttctaggactaaggcggcagaaatgcctcactcacgtgtccattgtcaatcaactgtcactcagcatcatcaatcgtctccatccccttttctcttggtgcattttttgaatcctcatggggcggcatatacgagcagagcccttttgctctctctgccgctgttcactccctataggcacaatctgtcaaagattgggtggccaggagctagaggtagacgaacagaatgactgggcatttcaatttatttgtggtaagcagggatctgaaccaccccgaatttgcaaaatatagttgaagtgattgagttgtgctgccaggctttgaattacggcccttgcacttggagttgtctcaaatgatcacggtacaaacagaccttcgaagaccagcctggaaacccatactggagttgcaatgtgccagcttgctcgggtcagctgagaatgccaaagtttacatttgtttcgatttcatgatctgcacgagctgtgatcttctggatactttacacttcacacacgtccaatgcctagagctcgcaaaaaccctacctgggtattccagaagctcccttcgacggctcatacagcgcacccgtcccctcatgtcttggtacctgtcaagaccactcaatggcaccagttctcgtccaagtcttccggctggactatcaacgacaacagaattaggacagctggtgaaagcaataagaaaaacgttacccgtggagttacaagggctcgtctacagaaacgtctcgggccttttccgtttccttgccggagcctctcttacattgaatgatctggataaaaaggccgggtccaatagtggagttgttaaccacccagtctcccatcattcagtgaaatcccttcgtgccaactctacaattatccttggtgaagaatgcttgacgagtatcgggtcggataacgcttcgaatttcgaacaagagattgctctgcaggataaacctgtatacggtatacaagtgtccctcggaacttatggcgtcgttgcccttcgagtcatctatcagggcaattctacgtcatcctggctgggctttggaattagaaaatggaccgctacgtttaaaggcgatgatcttactagacttcacacagtatctgatgtgagtccacggtttgtttggggactttgaatcacgctgataggcgcaggggttcaaattgataagcgttgggtttaccaatggggaactttcgcaaccgcccactaacttggctcacttgtttttcgaccacgacaaggtcctacctcccggaaccaagtatttgcttgcagatatgaagattccaggtgctcagatcctcggaaaccccgacgcacgtctggcacaataccttgatttctcccaccttgagatccaaagcttaacggtggtttgcaacatcgaagccatttacaaaatccaaatcaatgggggtggtcccaaattggagctaggcaatcgtgtagcaattaaaccatcggccagagacgaagagaacttctcaattacccggttctttcaaccaggcgaaagaatgacgtcgattcatttgataactagggggcctgagcgaccaatggtctggaaaggccctttccttcttgtgagtcgagccgtttcggaaagtatgggtactcgtgcctaataacaatagattcggacttcgaaatcaaggactctgtatttcggcacatttatactgccctttttacagcctctgcatgtctcatcatttgaatccgaggggactcgagaaattttggggctcttcatcgacccaaccaacatcaacccagggaagatcaacacccttggcgtgtgtttagggagcccgctcctcggtttaaaacaggctgggctccgtattccaaggtctcgtagcgattctgagcctttaatatttcctagtgtatatccctttgctgcatttctcagtagagccacgctgctgaacgtcctcacgctcaaggttcagaaatttggagaccgctgcgtaggaatgtgcgtggagcgacagggcggcatcattgagactcttggaatgtgggatcctgtccgtctggataccatttctaacatctacagctaccaccaaggtccgctccaacctctaactttcatctactcggaagcgcctgaacttctgaaacgatacgtggaggacattgtcgtctccgcatcaccagatcttgcacccggcagaccaagattcacttggagcagtttcggctcggtaagctaactcaaaggcgtatttgtagatgactactgacggattatcagcaactggcgtggtggtttacgccgagatacactctccttgaggattggcagggagaggagagcgacattctggagactgtcacgccgaatatcccgtgtgtctatggccggtaattgactctcatgtgtatctcaacttttcgcttcatagcgctcgcttattccgtattacgcttttgatatagaccgcttcctaatgaattgggaagttctcttctttgagggcttgatggcatcccggtctttatttctctctgatccactgagatatattaactctccatatcatgcacgtttcaggaggccaaaggaacaaaagtcgaaccacagctcgttgattggacacttgttcagttccgacgacaatcgagatcggttcgcagcgaacgacgaggatacggcgaaataccgaattgaactcccaccgaagggcaatattcccaatacccactttgaggcggccttggcttacatccttgtcatccgtccagcaacattttagcctcccaatattaacaaagaaggactgattcaggatccctgtcattggaagtctatggcggaatattccgctagcttcaataactgggctgcctaatccttggacagccctgtctcagctgatcggaacgagcctgccatgaggtcacgtaagatgctggcggcaaatcaagctcttcgcggctattgtctatgtctcacggtgttaagcgacacgatagtgccagcttacgatcagtgcagcctcgttcctcggtctgacgggcgcctagccagcaagtgcttacaggctgtggaggtgtggcgcgcggtagaggcccccaactcagttggcctagccctgccaatctatctgaagcaaggcagtttgttcaattctctaataaagaactgggctgccctgctagagtcgcgggggccgcttgccggatgcaaagctacccggacaaattggtggaagccacccccattattatatattaatgattgactaactgattttggtgaaatgtgcgcagatttgcctatcgagctgagcttgtctccctggcggaaaggcccctgtatacataagtgctggtctcatctttgtcgcgcttacgttaacttgacgagccgcgtctgaaatcatcatcaatatgacggtctcatagaacatcgggttgttcgtgattattaattcatacatcattagttcttcttgtttccactaatatcacactaatatcagcctacgaccacacttcgccgcgaccttttctgaaattgtcgttaccaacaacagcctcccttcgccaatgcggagatttctttctacctagcctatacctaccagttatcgatcgtgtaatgtttgaaatctcgagagaaaggaagagtcaatagggaaaaccgaggaatcaccaagcacggagcttcaagaagaacctacgtcaatgtctagcaagaagatcttgaatgtgcccgccgttggcattttcctgcgatttccagatctccctatcgagatccaaagcctaatatgggagtttgccatagccgaatccagcctcttatgggctgactggcccgaccatgagatgtctctccttgcacccatttgcccgataccaaagctcggcgcaaaagaccctgtcggcctaattccttacaagcttccaactggggtgcccagtaccttggatagccacccccctcctagtgggcttgcggcggggaccacagattctggttatgacacaagcttgagaatcatgagcatgactcacaggtcacattttactcgcactggtgactcctggacgagttcattgagaaagatgctgatacagccggatgagccatcatccagtgctttcgatggtcacgcggcgttgactcttctctctgtgtgtcgcttgagccgtcaagttgtgctgacacgtcgggctactgtcaggacgaaacagcaagccccggaaaagctgccaggcagtctcagcgatgtgcctctcttctacccttcgtttaagggtggatcactcggcgggaatatctttaaagatcagtatagagggcaaagttgtttcatttccgttctcggttctgatccgtcaaagcctttgtcgggaaagccacctctcggaaaagtaaagaccgcataccggtatagccatgttgccgcaagactgggggacattgaaaagtgtgtacttggaagtcgattaagctttacccatattccggatggcttggatcgagatcggttcaaggatgctgaagacacaatgtggtggagaccagatctgggttcccgtgtgcgacgcccagaggcgggccatcccttttacataaccccggggacaatcctcgctctttattctgcagttttgcatcagcttgcgagtctccaagccacaaaatgcatggagggccacgctcgaaatgactggtctgtacggccccatggacagtggtacttcagccttctcgaggagggaaaatgtactcactgtgctaaagatttgttattgccgttttgcgagagctatcctgagctcatcgatgctgagggccacattgatgtgatggtcctgctagatcggcatcggttcgagcagcctgagcatacacagtcagtgcggtcttatgaaatcggagagtgaagcgtagtatcatgtcggctcgagaatttggacaagtcttgaaagtacactctaatgcaacccaatcacgttgatgtacggcaaccagtggacagcactaataataaatgaatattgcgtaaatttcgtcagtctgggacatatgctaaaactaataatgtcatgcttccgcacagaagaacccccatttagctggattggttattcggaagatcgcccatcgcaccacttgtaaatgttttgtttagacagggagaacaacctttactcccatgtactctcgctgatgcatcaccttgccatcaataatagcctgatggacacccacacggttacgactgctgtcggtagggtctgcgcaagtcgcaatctgaatctcgcgccattctttgttggtgggcaccttgcccaccttgtccatgcgcttcttgaattctcggtagacgccctgctcatcgacacagccctctcgctgaataagaggtgactctgaaaaacatcttagtaagtagtttcgaagacaccgggcgtggattttcttacccatagcgggacccatttggaggtcgccgacagaactgttgaacaaaaccaacgacaaacgttccaggtgaagctggtcggcaggaggcttgaagactctgtgaagagtagccttgaagtgtcctccggaaacgatttcgagcgtgtctccgatgttgatgaccaacgcaccgggcctgtatggaacatagtaccactgctcatccctgccccagatctggagacaagacaccggcacagaaaacaattgagtggtcaggccgaaatcggaatgggcaagcacttgagtgggaattctatgttagctttatatcgtcttcgaaagtcgcggatgaaagagtatcttactataacacgattaagttagcaccatgacaacttccaaaaaaaaaaaggggggggaggggggggaggagggggtcaactcaccttcggtttcctttggatgcctcctctgtctccttcttcacaggccggaagagagcgtgacgaaaatatccttcgccagtagggctgccatgagactgcacgttatcccagaggtaattgtctgggagctcgagaacgcgggaaaagagtgtgagaagtctacggttgacagattttgtgagatagttgcaaaatgcctcgatttcgtccatgaatggtagaaggcaagtgggaacgcgctcgctcaggttgtcccagtcggacttgtaccagttgaactgctggatgccatcggcggggccctttgcgcgctggattcaaaggctaagttagaaggggaattcacgagtgtggccaaggattatgcggtaccttgaatccgtatgggtgcttgtagccagaccatacaccagtctcggggctgaagagaagacgctccttgtcctcctcgctgatgttgttgtacaggtactgggcaatggcaaactgtcggtgaagctgtgagggaacgggaagttagaaaaaaagacgtcgttaatgcgttgtttttgatgtcaaactaacctgctccaacgagatgccgtagttttcaaggaaaaggaaaccatcctcacggatcgctctcttgacttgtttgataagatcgtcaacgacagcgggatcatcagagtcgaggagggaaaggtcgatggaggtaagttcagcaaagttctccttttgctgggtgacaggaggagggacccattcaggtacatggggcttgccagggaggtcagcagccggggggttgaaaggggcgctgggtgccatagtgtttaggaagaccagataggagaatgattgagagtagttttagtgctggggatgggtcgttgataggcttggaatcatctgaatggttgtgagtgatgctagttcggagcttcatggaggccaaacagcccttttatcttaggtgccctatgtcaggtgcgcaactaagggaagagtagtgcaacgcatgttcccagtgactgtcagagatggctcctctaagcgggctccgtccccatagtacggaagccagtgttggccgagaaaggcaagctctagattcattcccaagagctcaatctcctccgatcgccacctgctctcctggacccataagtgtcattgcttttgctaagtcttctctgtggggcgggctcttctccccacggtcttccagcaaggtccacccagttactctccttatcccaaaccttcggttccgccccttgtcacgagataagagctcacccttcctaatttgtatcatgacacgtcagtctgatcttgatacgtactcgattgtccgggttatcgatccatctggggtaattagcagacatccaccggcctccccggtgtggagacagatgggaggagctcctccgtccatcaacccgcaccatggagacctcctcccgataagctagggagcacccgtttcgagtcatgaagcatacagacccttgcggagactgggtggcatgggggagctcctcccactcctcccccagctcacgcgaaaagctcaccagtcctcggcatcttaaaaggctacaacaatagtaattatttgccaggggtcatctcattatcaagcacatctcagctaattcttggatatttgcacgaaacaaaacaataaactcacaccaccacaccatcgcaattcaacccaccccaatcagcaaccatgtctcgcgaactcatctccagtgaaaagttccctcccaagcctcacaactgtatgtttcccttgctccggttctccaagggccaagatctagcgggggggactatgctcgaaaacatattttttttctgactatttcatataggccctgccaccaaggttccaggtcttgtcttccttgcaggtcagacggccaccggagagatcaagcaggctactgtaggtgtcattctcccttgaactgagattctagatgactaacgcatttttgatcgaacagaggaccgtcctgcagaacctcaaggaagttctcgagctctcgggttcttctctcgagcaggtcgtgaagtacaatgtttaccttgccgacatgaaggactttgctgccatgaacgaggtttacattgaattcctccccaagcccatgccttcgcgctcttgcctccaggccctcccccccggcgatggcactgttattgagatcgagtgcattgcccaagtataaatgcgggctatggttccagaaattagactagtaaaatatagataaaagaaattcataaagaatactgaatctacggtgcgccagtggtattctacttctgtacccctcctttactccggatgcgactaatgtaataggttatcttggcgttcgtcagacaaagccctctcagatcaagtaaacagtcttctgtacaccccctttggtgagattccggggtttgccgttttgaatagcctgaccttggtttttgtgaagcacagtcctccgatatcataatctccctttgagcacgtgtgtatgcttcattgcagaagtggatggaaggacacgagtgtagcacggaaaattccaggtgattcataatcgggtaactttcctgggttcattcataaaccgatatggtgaacacataacctggttatcagaggcgtgtacttaaagtacatgtaccagggacacacgtaatgcatactcctttagcttgatattgcttcataaaccatgaaggatgtcatcactgggaaagaatcaggccacaaatgatcagcaggtcggtaacattcagctgtagaaagaagtaaaagataaaagtccccacacgtatcttccggcgcgtaaagaacaatgtgatcctactcgtctataaatctaagtggcgccgtgcaatttcaaacgttttccaccgtccccctttcctcgttcacttatgacctcgcaatctcaaactctgatatgtaccagttctgaatggccttagtgtctccggtgatggccacggtatcgtatcttgggcgctcctccttggccactgtgccgttgttcaccatacgcccagcccacttgccatgcttcctcgccgcagcaatgatcttatcaaccgcagcgatgaattcaggctcgtctccccgtgcgggcgtgtatcccaagagcgactgagccagatcattgggtccgatgaagactaaatctacaccgggagtcgccgcaatagcgtccacgttctcgacgccctcgcgggtctcgatctggatcatagtgaggatggtctcatttgccgacttcatgtactcgggtgtggtcaggccgtgcccgatagctgggaaggctgagccctgtccacgcacaccctgtggggggaacttggaggaggccacaatctgggcggcttcttgagcattgttgatttgtgggaccatgataccgtgggcaccggtatcaagggcgcgcttgatgatatcgtgggcaggtccgcggatacggataatgggtgagactcccagggatgagatggcggcgaccgagttgtgcatggagtcgtcgccaatgtgaccgtgttcggcatcgataatgatgccgtcaaggccagtcagggcgacaatttgagcctggcgcactgacgggatggccacaaaggtcatcagggggtactcccctgatctgagcttattcagaagcctcagacgagggttctggacttgcgtgttgtgggcagttgggtagctcattttggtaatgtatgttctgtttgagagaattacgtttcttagacgatgactatgaagccaagccagggtggcggatgataagaaaaggtagacttgatgtatgtgcaagttgtctttcgatattccgaacgaaccccttgctgatggcgggttttatgcgccaaacttgagctacttttccccagatggagctaccatcttggagagctcttcgggatattcaaggagagcaccctcgggttgcactgcggctgagtcaatgatgctaagtggttagttgtgaagctaagaccggggccagatctgagggtctccaccgggaggagctcccccgtgtcactcgcaatcacgaacagggaccagccggatcaccaaggcgtgagctcctccgattagataagggcccaccgcttgtgttgggccttggctgcgtcagggtctctatcatgcatgcaagtgggtggcgtcggccttgtccaggctttctgatatcagtctctagaccgagtacctagtgtttgatagacaataacaaccataataacagcagaagacaagataacgaactaccagattgatcatttggaggttatttcaatgcgtattgtgttgttcttttggatattgtggcaaaaagacagtcaacagcatcgtagagtcaacggcaacggtgagccgcaattcatgtcgccgctaaccttctgtggggaccccagattatgcaggcgacgagtagactgttcggctaccgggctacgtacctcataccgctgctgagtctagtacagattcgaacgggctaatctggagtttcctatcaaagcggatactacgcgtgctctccacccaccctgtccgggcattccttggccccggaccaagtttgactcgaacaaggcttctagcctgtctatactctccagcaatatcatttgtaaaatggttccggtgattcgtgcgccagccgatcgcctggagtagaaggtcaccgttatctgcttccttgcacaacttaaatactcagtctccgtccgtccaagacaggattttcactcaccaggttcagagccaaagaagaattttcaactctcaacttccaacccggcaagacaattccttactccatatcccctcctcccctcacaaccatgacttcccagaagggggatgacgacggcaagaagagcattgctctctcccagacggacggcgaggtcgctgatgtgacctatgaccggatgccggaatctcttcgccagtacagcgctgacgagatgaaacgcctcgagaagaagcttgtccgcaagatcgacctggtcattcttcccatcgttggaatcctctacatcttaaactatatcgaccgtcagaaccttgctgccgccaagttacatggtatcactgacgatcttcacatgacaacggagcagtttgccactgcgatttctatcttattcgtcggttacctgccctttcaaattccaagcaatctcatcatcacgaagctgtcccgacccggcttatacatttgctgcgccgtggtgctctggggcagtatctcagctgcaactgcagctgtgaacacctatgcgcagttgcttggcgttcgtgctattctcggtgttgccgaagctgttttctttccaggtgctatctactacctctctgcgtggtacaccaagaccgagctcggaaagcgaattgccagtttgtacattgcgcagcaagtcggcaatgcatttggtggtctcctcgccgctgctatcctccagttggatggccgtcacggaatccgaggctggaggtggctgttcatcattgaaggtgtggctacagtcggaatcggtctgatttgcggcttcttcatgcctgaatttcctcacaacagtcgtatccttacccagctggaacgcgatctggcagtttggcgtatcgagtccggagccggtgcagcagagggtacagagaaggaaagcgttctcaagagcttcgccaaggcccttaaagatcctaagcttctgctgttgatcttgtgagttactccccatttgccgtcatcagacagacatgtttccttcactctttatcttgagcgagactaacacaaatgcagctgcaacttcctttctcaggcccagggatccattgccaacttcttccctactattgttgcctccctcaactataacagcactcttaccctggtgctcaccgcgccgccatatattctcgctgccggcgtctattactttatcatgtggcactcggaccgcaagaatacggcttatgtccccattttgatctgtatttctatcgctatcggaatgtacatcatcccgatggccaccgtcaacattggcggaaggtatgctttcaactaatatggtgccatgataccgcctatttactaacatattcttaggtacttcgctatgatgatgcttccattcgcctccgtcggtccccagcttctcctctacaagaccatcaacctccacctggcacgacctgtggccaagcgcgcagcagcttctgctctggtcaacgccatcggaggaacggccaacatctggtcctcctacctgtactttggtgctccccatttctatgccgctttcggcacgctcatgggctgtgctttcatcttcatgctgaccattactttctaccgctggtacattctgcgcgagaacaagcgtcttgattctggtgagccagagcagattgccaaggtcatcaagggaggcgtcacggaggaaatgatccagctcggatggcgctacgagatgtattaatcgatgtgtaatgtgtatctccattctatcaaatagattagctaggtctctattcacggggaatgatgtggatcatggcaaggtgagagtgagggcgtgtcactcctgccaactggtttaaatagaaggctgtatcgtaagccagctacttctatcaaatagccaccattgacctacttttaactatattttaataacctcaggttactcatataactaaattatatatattagttatggatattactaactatagtcatagctcatcaactacgtgatagaagaaatgatagaataatattgtggtagaaaacgatataaatcaaaatcatttcaaagatcatatctcagctgtttgcctttagctctcaatagtctggcagcaacatatttcgatcatcgtggccaagatcatggaaaagccatggcagtcagcagatcccatcgttacgtaacgaaattggagattttgaggggtagcgggccaattcgcttaagaagagaatcttgagaacccagaccttgcactatggagccgggaacttagttcagccaatggccaagcgtaaatacagtggagagtagataagcgcacggccaatcacgcgtggccagtttccagtgtcatgcgtatgcggggagacctgctggaagactgtgggggaggcagtcagggcccaaagtcgctatctgccccctaccacggcccaatcaccatccctggcctcaatctacagtgggcttcgcttgcttatcggggcccagccgccctcaattgcctgttatctcacacttcggctcttctgctgcactgcacctcgctccttcccccccgccgtcgtcactaaacgccccccagcaggccatcaatcagccttcccgatcaatccccctggcccacgcatcttgtacattaattatcattcctcacacctctccccatttcctcccagcatgtcgattgccagcgccagtgccaatgtcgccgagcccaaacgtcctcccttccagcccttccagtgccacatctgccacagccgcttcacccggcacgagaacctcaagcgacatgccgccctccacaaccgctccccgagcaatgcctcgctcccgtgcgagttttgcagtgccacattctcccgtcccgatcttcgacatcgccacatgaagaagaagcatgccgagttcgaagacacccgcccacgaaagagacgccagagcccccgtcaggccccctcccctccagcacaagcgatcctacaagcagagaaatcacgggttgcttcccggggcagcgagggtagcgaagaggacgatgcacaattcctcacggatatccttgcgcagcagccacagccttcgacggccacgagcgagtctcccagcatcggccatcttgtcgcagccgacctgggaccaagccctctgatggggacgtccctcctcgaccccagcgcagggttcgacgtgcaaatgcatcctatggatataccacactcgacgacgtcgttcgccacagacctatcctgcttcaacttcgaccaagccaccccggaagagggcttcttcccaatgagcttgccccatttgcaagacgactggttcccctcgaataatcagatcacgcggggctgcgatctcttcttcacccatgtatctcccttcgttcccttcttacaccagccgtccttcgacccctcacaatcggcaagccacctcgtgctgagcatgctgtgtctcgcctaccagtatggcgaggatcccgacagcggcgaccaaccaggatctggccagagtctgtcctcgcgaactttccatcgagcccgtgctcttgtcgccagcgacgaggagggggtcgaggatagcaccctggcacagcacgtcgccatggtccaggcatactttcttctcgaactctactcgatgatgtatctctgtgggaagaaagattcgctttacggcctcaagacgcactccaaaataatatccctagcccgatcatctggcatggctcaacccacattcacaaacacctcggaggcaacagaagacctcgactcgctgtggcacgagttcatcaaagcggaatcccataagcgaaccatattcgccgtccaccagctcgacacgctctggtaccagttcctttcgatccctcgattgttttcccacttagaaatcaagcacgaactgccttgtccagaggactactgggcagcacctacgtccgtccaatgggcacatcgacagctcgtcaataaaaacacaggctcgtcggttccataccccgatgccatcaggcgtttcctatcccccgaaggcgatcctgcgtccatccccgcgttcgattcctacggcgccatcaatattacgcatttccttgtttctagcgcccgtgaaatctctggctggtccaccatgaccgggatgcttagcatggagagactggagcctttgaggacttccctcctcgccctcagtcccttcattcactcacatccggaggcatcgaacccctcccacttgggcgaggcaacgtgggaggcggccatgatcgaattacaaatgtggtccccgtcacatactggcgggatagtcgagggcagcatggatgccgtgatgcaccaattcaccttcctgccctcgtcgtgcgagtttctctgcgaggctgacaccgccaagacgatacagccgcacgtcaattggttcctgcagtatctggacatggagcccgtaccagatgcagaggcgccgtggatcattttatactcctacaaggctttcatgattgcctggcaactcgtcagaggtggggtggcagacgcaatgaaggtagtcaatgtgcaggatggagattcggagggagctctggcctgggcgagggaggcctttggccgcaggcagcgatggcagctggggaagattgctttggcatgtttagataccttgacagcatgatctgttctctattatgactagttatgaatgtacgatgaaattgattccatttcttaaagtctaggccttgctagtcattaggatttatgatggatcaagtaatctttcccaacctcatgtaaatatatatatattgtcctgctaccataaccaccaccacgactaacatatacgacactaggagatttactatctatgattgaaaattattgcaaatgacctattttcaaccgctttgatattctagccagcttctatatcctaaggtgtgcgggtttattagcgagtaccaatcagctaccgagatatagggtagtggtggttaactatgtcaaaacgtggatgttcgtgaacaagccccttcatttgtgcctcgccccggactctcggatgcgattacatatagcccgtaaccttgctgatattttcaagctcttttccggaatcaatcggagttgtttcactgcaaatggggattcaccccagcggtttgtttcaaaaggattaggatcatgcctatcatttgactgaagtcctgcatgaattgactgaagtgaacaagttcaacttcttgtgaatgtataatctgaactgtgagaaaatttctttgtttatgtcttgatgctgagctgctcaacatgcaccccttatctacagctctataggctgaaccagactaaagaaccaaaatctccaaacgaatgcagtctaatatctaaacatctatgaactatgattggatttccaaaaccaagccaaaagattataatctactgccatcatgacgacccatccgaagcggccgtgtatcagtctgtgtctgtcccccctcctccatttctctcggactcctccgcctccgcctccgtctccgtcgcttcagtctcattgtcgctccggtcatccatgctgccaatgacatcaagcttcagctgcggctgcgccttgaccgcgtcctcgatcgccttggggatgccgttctccccctccacgacgatgagcctcttcagcttccgggccgtgattgggaggttctccagcgcgtagacgaacaggtccgtgacctcggggtccgtgcccagctcgttgaagaactcgagcgtctccagctcgggtggaaggcccgccgagtggagccgcggcttcttggacgtcttgccgaagagctggtggtcccagttgatgcggagcgtcttgaggtggtcgaactcgcggagggcgagcgcccggtgcgtcatgagcgtcgggaagtcgatggtgaccgtctcgagcgagtggcacgccgactttacggcgatcatgtagtcgcggatgctgtcggagctctcctcgagctccggggacggctcctcgttctgtgtcatgacgaactccttgagcgccttggggaacatgaggaggtcggagagggcgtcgtcgttgatgtcgcactcgatgaggtggagcttactgagcgccgtctcgtggggctgctcgatgaggtcgaagccgcggtagtcgagcttcgccttcttaatgacaagcgtctcgagggtggggtgggcgaagatgtggatgttctcgtacaggtcccagtactcgtcgttctcggtctggtagaagagcgtgcacgactggaggcaggcaaggtcaaaggggccgttgaacagcatgcccatgccgtggagcagcgtgtcgggcacggccacatcgagggtctccagattggacatggtggatatggtccgggacaggctgtcgaagggcaagggggggtggtcctggtgcatctgcgagccatggatgggcgcgcgggagattaggctggacagcttggacgcagggtatgcgagcttgacggcctggatggaggagccacggcgagggcggcggctgagcgactcgctgaaaatgaggtgcagctcgggagtcaggaagtgcaccgtcttgtacaggacggcatcggccaggacatggtagcgcttgttcagccgggacacggcgcagaggtcgcgcttggagagtcggttgacggcctcgaaaatgtcaatgaggatcgcgtccggtaacgatgccagcctgtcgctaccggcgccatggtgatgatgggagtgatgagcgccggatcgatggggcatccttgggcccggctaggaagagactggagacgatgacacttggcacgtcctggagcgaagcgcgatgctatggaagtctatagaaccaaaacactgggagttgagcgagagatgctgatcttgattgattgactgacggacgattccgtgtgtgtgactttagcttctaggtgctgctgatgattatccggagaattgccgcggcaaagaatgaatgtcttgggggaaaagtacaatggcgaagcaagaaataataggcatagatgcaagggtgattggcaggttttatattatacccatagagtttctgagaagaagtgaagcaagatgtaaaaggctggggcaaatgtatcacgaatgccaacatgtgaagtaggtacgtacctgtcactaatctgcgataagctttggtcacgtgctacaggaacatacggcgagtcacatgacatttggctgctctcagcttgaatcgactaagggataaacaatgtgtcgttcaagcttccgagacattaaggattcctccattgttctagattcccttggtcaattaggcatgaagaaacaccccgcacaatctatgtgctgattagccgtccgcaagtggcgctactgtcccactcagcggtgaatgccagtatccgcacacaagctttgaaactgtgggcttagcgaatgctggtggcggcggtatcattgaaatcctactttctccagagagttacaagcaaagatgtaacatggtcaacgcatcaaatttcagctttattgcccggccataaggcttgctgcccagcgcaccatcatggcgaagtttcttatcagaatggctggcagattgaggtttcatcatctagcagcaattcttctaagcccattgctaatcataccttgtttctctgtggcgagtgcgagcaatctccggaaatctcgtagtcctgtggcaatctaatcatttattcaccaatatcgaaacaagaaactcctcgatttcattcaactcctcccggcaaacagaatggccgattcccctaaaagaacattagagatctatatatatatatattctagcggagtgaaaaacttgcctgtatctgtagaaagcgatgttgtagccagccttttcaagcagttcggcactgtcaatagccacttgatactctatacgccaatcttgatccccgtgtcccatgaagatgggcgtgtctttgttcaaatcttcgtctggaatgtaatctaggaactccttatgaagtagcacccagcatgaaagcgcaacgatacccccaagcttgataggtgcggtgaggccagagaaaatacttatcgctcctccttgagaaaaccccccaagaatgattctctctagtagaattccggcttccatttcggcctggataagagagtgaatgtaggactgtgtctccaaaacgccagagacatcttcgccctgacaagcggacaacgaactaagacgaccaggcgaacttgtctatccccaagatcagtaagttaccgaggcgtgaacacgcattacacacaagatcaaaccaggacctcatccggatgccgcccgtctggcagaataaaaacacgcatacatgtcagtaagatgcgctcccatcagcgtggatacatgcacttgccatgcttagagggatatttggcgcgtgaggaaggataaacttgacgtcgtccaggcggccgtgccgacggcggatatgctcaacagccgaggaccagccatggcccgagtcaccgaaaccgtgaatgatgatcaccgtagcagtgtgttgccccgatattggggagagaacgagcgggtcctctcgagcaggtgctgttgacatgtcgctttcgggccaatggattactttgccgtagaatcagttgttggacttgagatgggcagaatacaaggatgctttgattgaacttcctcggtgaggggtaccaatgccgctgtgtcgcgcaggatgtaacactgtatgcgccattcttggagatagatccaccctacctaactattgagggcggattatcacaagttcaagcagccttcgacacgccaaaatcaaagttccggtttcgagaagagcagcgaaaacgatttataattgtctcatgtgcctatccaagagtcatttctgtacacgtacacgttgtatctatcccgaaaagtattgcttgcttttcctcccaactccacactttgcaaacaaccaagctcctctcatctagatattttcagtgggagtacagttccaacaaaactttctgtaaaaaaaacttgggatactcattacacctgaattcctagcaagcacatccggcaagtcttgatccttactttgcagcgagaccctgggcagtgcttcacgtttgaatggaatggctatttactcaaactggtattcatcaatccctagttctaattattcaacttgatagagtcagcaatatcgtttagatttcccacgagaaatttcctatacactactctaatcaaagctcgttgcgtttactcctaggtcggcactttcgtgaggtgctcggagtagcggcaggctcagtggtcgataccgggcttgacgatggcatagttgaaggtgtcgaagacggagtgtcgagaggctgcgtagaggagatcgttgaggatggcgatacagatgagtcaggtgttgaagatggtgttgaagatggcgtgtcaacaggcgtagaatcgatcgatgaatcaggcgtagacacggccgatgatgatgggtctgtagatgaatcaggtgttgaagatggtgttgctgttgaagatggtgttgctgttgaagatggaatcgtcgaagatggagtgtccgaggataggattgaagaaggaacgcttgtggaaagtggtgtcgaggatggggtacccaatgataggaccgtggaagataggtcggttgaagatggtgttacaacagatgattcgcttgtcgaagagggagtcgttgacgatgggatagttgaagacgggatggttgaagacgggcaagaaacgctcttgaagaattgatattggtttgaagatagtgtactgcaagtgattttggcggtctcgtagctattggcataaagatagcaagcgttggtattataccagagatagaaaccacaactctagattagcacgtcagcctctcgtcgccatggtcgaatcccaaatttcggccctcgcaacgatatacttacgctggaggcggcacaagcagttccacattctgcaatgcttttcgccgagggtgcacttgtaacctgtttatcttgttaagatgatggttcacagctagattcgggtatcaaagtttcattaccccgccagttgaaccagcagcactacagctcccacccgttgcagcggcttcgaagcatgcggtagaaccaagtgttgcaagagaggcaaacacgattgccttgagcaacccctgcataatgctggttgcgatacacaggacttaaagtagacgaagaggcagcaatttggagggaaaataaccagcgtatcctaccgaagcaggtagacaatgtcgtgacaaggcgaggactagcaagaaggcatatggagatgggcagagtcacaagttttccattcaaataaggcgtactcatcgcccctggatcttcattccggctagccaggcaccgagaagatctccacctaactcaacacaacggcctttagtttgcatgattcgacaccaatagcgccatctagcgcagctggtttggtctatgtagatcgaggccaccaaacctccgggacaaacatgccgtagtcggttggaggcctattctgtctccaccctggcgctcgaatacttagatatgacatgccggactgacgatcgaggaattttgtattaaaagcccttcgttaccctgttgagaaggtacaacaagagatattgcccaaggactgagttgcaaaaacgtcgctcggtacctttaacacatatctgccccgtggttaatgttgaagcggctgttactacccgaggtaacttgccagacatgccaatagcaaattgaaatctgttacaactcgcccaaagactattttctcaactgcccagacgttgcgttgatgtcactgatgtgagaatcacacttccgtcttgccgaaaccaatatgatagcgggctaatggtccaggcttagtatcactcttcgtagagtagagggctataactctttgattagtagccttgatagtcttgcacgtttgagttgctccttgagcggtgggtaacggagaattcttatagcattggcaaagtatagaaatctagtattcatgagagaattgataggcgtcaactgcagattgtgttctagagcacatggcactatcagcacagaccagcatgcttcacaaccgcccaaggtgggctgcctagtgtccattggccttggtggtgtcacgcccaggataatgctagagtcgctggccgtcgtgttaggggatattactggctcttgagtgataatcagtttcttcagatagtgtagaatgtcattctacccagaaaatctggcaaattacccttcccctacgcttatctacatacatatctcctcatgtatagatgtcaattatatagaggccgtcactgatgaaaagtgctgtgatgaatagaatatgacgaaaatgaagcctagaccttgatctgattatcgaattatgatacattgctggtccaactcattgacccaccaacgtgtagtacgatcccagccaaattcccgccataggttgtcggaatttttgatgtcagacaaaatccattgtacaaacccaacccgcccataggtgatacgcaatggctcgccgactgcaccttgttcctgttcttcttcgggatagggatagagtgctaacccataaacgtaaaaagctgatgccgcgacgatgaggcacttcacttcgccagcgtcaataccctcgatatcctctcgccactttgagatcacgatgggagatgaggtctggttaccattatcgtctaaccccgctaagtaaggcagcagcggtatcagtctacccctgagcgtcaactccccaatgagaggctcggcacttcttgttgcctcatcgtgggatagcgaatccgagtcagacgagttctctgaatcaattgaccagatattgacgtctagaacctcaatgcatgggtccacaatgtagtcttctgaatcatgcgcgagttcaaacgagatagcaccatggagagatatccaagaccagctgaccgaactgtagatctctccgggtattgtattgttcggatccttcacccaccagagaagctctcgccataggaaagacttccacatgccaaagactaactcatctccggtgatactaaccgtcttgtttgcaatgccagacaaagcaagtagcttgtctgcctcctcagacagttgccgggcagagtagttctcaataacttttctccagtaaacgcggaccaactccttctttgtgtttagtgactgccatgatttacccctgctaagggcggccttgaagagtcgcaggtttctttgactgagatccgagtcatagaatgtaggaattccagaagggaacgattctgaagcattcagtgatgcacagtcccagaatagttcattctctgagtaggtcagtatcctaggagagaggatttgttcttggaggatccaacctctcgtgtcaagcacgctttttggacggattccatctccagtagcaagccaatcggcgaatacatacaccggcgagccatctggccagacccgttggcagtcaacgggccttactctacctctctttctttgtctgaaacaaccatcccgggatttcaaggctcctcctccggctgcggatatcgtaaacagagaattctgataaatggaggccatagactcggcttgaacctgccaatcactcctatcgtcttgtacgatgcacagagcatccacccacaagtaccggagtccgcacctcctagtaatggtgatcgcgtcccttattgtctgcgaaagtttctggactgggatttcaaagtagtgctgctttaggttacgcctagtcgtcatgaaattgctggtatgctcagaccatctgtagctcagtgtcaggtaaaggccgcgtcgaccttttccaggaagtaatttaggcgcctctgaaccgtcttctggtccgacatctataatgcgctttggcaatcgagttaactcgatcagttggcctagcctgcactctgcatgctcaatcagacaagtcttcaaccaagcggctgccatttgaaaggcacagtttgaaccagttgtcttgtcattgtctgaatcaaccattcttttcatagtcttatgcatagatcctatgcggcaaactttagctactcatcctgttccgaattgcgaaaaaaaaaacttaccactcaattggtccataataagtgttgcactgccaagggaggcagaattcttggccgtctgcatgcccttgaaagacgtcttcgtatttatcaaccgagtctcgtcctctccgggacagcaatcacgtttgagttggcaaagagggcaaccgggctgcagcttcgaaccattgacctcttgcatatactggccactgcctccaagcttgctaacggcattcgacacaaccccgtcacaggcggcacagagagggtaaaaggcattttcagttgagtaatctcttgcgggagtagctagagcggacaagtggttgagtaatgcggtgacttcgaagctcattgttgggaaacccggatcttctcggtatccaaagattgaagttgtctcgctagactcagagacgttgctgatgctatctaaaaatcactgttagagcttactggggcgtcgatggatttggagatatcctaaccgatttgtccagattccattttgtgaaatatcctggcagtccactcgccaagattcacgtctgtagttttagctgaagtaatgaaggcgtcattattctactcaagttagcttagggatcttcgaggttctctatactccttaagcgtacgtaaagttcatccaaggttaaccgttgagaataatcagaaacaaggcactttctgatcaaactgcgaagtgattccggacaatcgtggtcttcagatatctccggggccagtccatgagcaatccgtactatcagctggtgaatattaagcttctggaagggactaaagccctgaaaaagctcgagtaggcacattccgaagccccaaacatcatttgaaggcccgtgagacttgttgagaatcctttctgggcttgcatataggcacttttccttgtatgatggcaagaaggtcgagccagtttcgtcttcaagcaatgtggagagtccgaacccaccgagctttatgtcaccattgagattagccaggatccgggatgtccgtacatcccggtggatgaaacccttctcgtgtaagtagagcaaagcttccatgacggccaatgcgacttgccccaaaatatccacggggataggtccggtgagatggactattctctgaaatgacctatgcagaaatacaaatcagttagttcaaaggcatcaatgatgtgtctcaagatcagagatctttttgtagcaccaaccccagttccatgtactccatatataccccgaggctgtcaatcagtccctgagttgcccccaaaaatgttaccagacgatttgatacacattgagacatcactcggaaatcccgtatcagctgtttccgatcaaccatgtcgtagatctgctcacgataattagcaataagctgtctttagagtttagattggcccggtacagagcaccactatcgcacccgttgtatcatcatgcttcctgtaacacgatggcgcacgacccgcatttgccctcgttctccaaacaccttgaggaccgaaaaatcggctgttttgagatccagccggaaattcaggggttcaacgtccacagaatcttcgtcagggaccccctctccgtgaccgatggcttgactttaggttttggtctgttttagtccatcgataatagtttgtctcatataagactcaagacgtacagataagcagtctcggggacagttacgctttgcaatgtatttgacctgctcaaggtacgaatatcggctgagttattggcctctcggccctccgattcacgatccattggaaggaagataaagtgagctaactcggtttgtcgtggggatttcaaagctttggtgatgtgtctgtaggtcaaccccgctctctgcaatctggtgaaggcaacaactctgacgcatcatgtaagccccacgcacgtgatcgattggcgaggcaaaatttatgccccatctagagatgtaggtttggtgaatcgattatttactcgcttcaaaaaagtagtatctgtttttactgttatgacgctctcgtttaatatctctttgcattagtaagccatggatcgactttagtatgtgcccagttgatgtctggagataaaacacaaatacagtctttccaattgcctatatgaactggaaacaaggataattagaatttcgtggcagttaagatgtcggtttatgcgagggcttgcttctacatatgattccatacctacaggaatagcacagaaataacacagaaataacacggtggattaaaaaacatcacgaaggatatcctagcctactgggctagctcctttttcgtttgcccttttgccctttgatcacgtacaggccttgagtttctagttagcaataaaggcagtggctgtaaagagcgtctggcagcgtttcttccatcgtaatttggaagggagaaaagtggagaaccgcagctttgagtaaaggcgctgagatgccaagaaaccccgtcctgtgccacagtttggccattgtccgcgaggggcgtctcgcatcgacgaacgcttattagagacaatggcgcccgtggaacggcgaccctagtgcgcttacggccaatggaatatcttataattcaactcttcgacccgagattatcgaaacaggagaaaacatgggaaaacccgcggtacccggcaatcagacacgagatcaagggtacccaggtcctctgacgcatatttgggtggggttaataacactgcatctcggttacggtactgtaaatttgagcagaaacacagctaaccccgattctagaagctggaaaccccacagacgtcgtgtcaggaatctcattttccaggggcggccagttccccaacccacacatcacatgctgcatgtcgactgcagggagtcggagtcatcatcaggcgactaaatacggtggctcggcagttcttatatgctggagactgggggccaaacaaagaacaattcaacaagtggatgagcatcgagactgatcctgtcttccgaccgcctttctccgagccgccatgtatttgcactcaaaggcggggagattgcaataaacgcaataaatcgtctaaatcctaccagccatacgcggtaattatccttccgggtctcgccacacacatggccttggcctagttcaactgcgcaggatgcagtggcaaaggggcgctcaggtaggacgtagtagtctttcattcgagcactggttaataaaaggagccaggtggcacatttctaaaattaaaccagcccagcacaaaccactgtgctctcttgtccttcggctccgctcgtgcgttgcgcgagtcggcgatccccctgagaacacgcccgctccttttaggctcgctttcgccggtctggacgcacatcatggcggccgatctggaggacggaataagcagacagggagcttccgcgcggacaagtctcacagtaatacgctggcatcctcgtgacggatcttcaccacctcgtgtcacattggatcatcgcgcgaagcatggaccacgttaggatccgagccccatatccaattataggcaggttggacttgttttgaaagcaaaccaccccacaactgcatgcgctacgcaatcaatttcgccggctgactgggttgtgggcatgagggcggcatcgtgctcagtctggcctgtgccgggctcgctctagtgggcgtaataataaacttgtcaccgcccatgacgctatttgcttgctttttggaggattcctggctcggtcccctttccgttctctacatatcgtcgcccctcgacgcaaatgacacgcctgctctcggccaccgtattacactactcgtggacctgcttcgataccaaaacgccctggccggatgcggcggaactaacctccagatgaaatgtcgggtctcgggatctctctcgacggtctcccggacattgtgcaggagttgcagctggccgttcgcttcgaggaggaggaccagcacgatttgacgattcacccgccgtcctcgcaccgtcacccgacactagaaaaatggacctggaagcgaatattgggacaaggggaccgtagtgaggtcattttgcaggagagaatcaccgcccaggccgaccagccgaagcttcgtgtcgtgaagagcatccgcctgccagacgatcccaacgaatccagcgcacatgtttatcaacacatcgagcttgtgtccaaattctcacaacccgaggttcgttccgccctgtagtacacgatagcgaagaaaataagatgttcatactgagacattcactccagtacgcgggccaattcgccacatgccttggttggtatacaggcattggtacggtgcacatcgccacagaatactgcgaactcggagatctcgacagatacctcccgaaattgggcggcagactcttcgagaccgatatctacgacgtcacctggcagattctaagcgcgctccgcagtttgcacgagcagggtttcagccatggaggcctcaaactttctgtaagtcccgaaaccaaagctcaattgcgcagttcctaaccttgttcaacttgtaagaatgttcttgtaatgactacccatccttcttggtgggttaaactggccgatttcggcctgagcaagctgaatgagagcttgacgggcatgatcaccgcccgagggatcctacatgagatagcgcccgaggtgcttgggtacagcgggaatccaagcaacgtggatccattccttgtcgacatgtggtcgttgggacaaatagccttcaggatctctgcagggcaccccatgttctcttctcacgagagtctcttctcatactgcgacgggcagacaccgatccgagagtcggtattacggaggcatgccgtggaagagaattttatccagtttatcaaaggtctcgccgagccacggcctgggctgcggctatccttgagagatgcattaggattttcgtggacgagggtataccaaccttaccagactcagccgatattatcgcaacctcagtcgatcacacccaaggctcaacaggctcaacaggtcgtaacaaacactccgccagtcgtatcgaagccggtcgtacctcagcttcaaccggtcgtaaccaaaactccgccagttgcatcaaggccgatcgtacctcagcttcaaccggtcgtgccccaggtccagccggtcgtatcccaactaaacacgccgaggagcgcactaccctctcctgctgttgctagtaaccacttcgaaaacatcgaaataccatatgccaggtcagttgaggacaacaacgcctccattagcagtcacggcgacgcagtcgacaagcctttaccgatgaaaccaatcattacgagtccgtcggatcttctacttccccattacgatcagtcgagatctcccaaatctccagcttctttccaaaagagcccaaaaagccccaaaaatcacgacgaggagcacgaagatgaaacgaacaagactggaaagcgaaactggaagtactttgccaaaatcgccaatggtctaacgcagagcactacctcttcaacgtcaggcagcgaagagcaaacgcacacgaatcagtcatcgaggaaaggaggaagcctgcccaactcgccctcactaaagtctcctccacgggtcccatcaggttgggtcacccacttggacgagccaactcagcagtggtaagattgcggtgatcaagtaatttcatataatcaagcatggacgcttaccaagacatgtgtaataggtacttcgtcaatcgattcacaaacaattcgcagtgggaagtgccgacttctgctgcgaagccagttaaactcaaggagtcgcctcggcctgataccccagcatcgtcgaaaacccgcaagagctccaaggctcccaatgcgcggattgcccgcttcgaagaaaattatcccagctgggcgatataatggcgtcgggtttccggcgtccaggtttatgaacatattacaagtaaaatgagccagaacttctgattcatactcccccaggaattcttcatcgcaagcgaaatggctgtgcctataatgtctctaggaacagtcattgcggcgtagaatgatgaagcaacaatcgaaacgggaaaagacacgatcacatcttttgtgtattgaacaagaacagcgcttcacgcctgtcactacctatggatttataagtccaattcgcgtcgactcgtcctatcttcgagtcttagaatttaagacttcgggttaacttacccagtctaatatctcaacgggaccgtctagtattgtatagtagttgagtcaccgatattattacaatgaataaagtgaaacaagctaaagcggatttatttctactctctgagcctgtgacagtgcatggatgtaatgaatggccggcccatgaatacttctgccaacaataatggtacctatgcctagatatttctttctatctcccttttgactttttaaactctttcgtctatagactgtgaaaggtttcgtaactgtatttgcttcttatatctaaggcgtggagccagaggatggccgtgtcagaaggcttctggcatgctggaggttggaatagaacccacgcaaatataaccaaaacaaatcagcaggatggccgatgggggcccacaccctctacatctaagcaatgaagaatttatttcctttcataattacaagactggctttatgatagtttatccagctggtgcaatgctgcctgcgagagaaagtcataatgctatagggtaggtatgagcatttccgtaggttggttttggttcagggatatgagcatcaattgtgttaaaaaatgcccccgcaatcaaaacaggtggcaaaaaaatcccagggcgattccaatgcaaatatcagattaagattggaagaaaacgaaaaaaaaaatgaaccggttgaaccggttggcggactctcccgccgggaattgaacccgggtctcaagcgtgacaagcttgcatactgaccactatactacggaagatgatcaactgtgttcagttgctgtagtgattggtggtgggtcagttccaaattgaatatataacccttgccctgaacacgtccacttactatgtactgattcatttgctgcttcgtcaacgagaacgtggaaatacgaggctgatgtatgccattcgcaagattaattcctaccccatggctggtaatctatttccacaaacagaagcagtgactggttgttgcatgatagatggcgtctttgggttgctcagagtggtcacggttaaagccagcacattggctctttcttagtagacgttcactctatcatgaaaaaaggagactaagtttgtcattgagagccttaaaagttgtactcgattaagaaatttcgtttctcactactactgactaacgagcgctgacaggaatgccgtatttatgacatagtgctgcccgtttccctaatctgacaggttcttgagcttctggaccttcaaaacatactggacatgccacatcttgagcgactcctctctctgccaagatagaagcttagccatcttgatagtgttcttgatctgcctgccgttgaggttcaacttgctaagctccttgatgtcagcatcgctgagttcatgagccttggcgccctggtcatcgactggctcgaagaatgcacgccagacttgctcgcgtgaagcatctgtaaggttgggatactctagagagaggtgaatgcggctctcgaacgcgggatcgatggtgtcgacgcgattagttgtcataaagaggatcccctcgtaatactcgagcatgcgtagaaacacggagacaatcgagttgcgtgatacattaccagtctcccgcttttcaaggtacacatcacattcgtcaaggagcaggacagcgttccaggaagccaccatggtaagaatcttgctcatgttgtactgcatctcataggcgtaggagcctaggtcgctggcattgatcgagtacaggggcacacgcatatgctcggcgactgtttcggcagtgagcgtctttccaatgcctgggctgccagacaggagcatgatgatacctcgacccttgccggagataacgtcgtcgaactggtctttgcgtttgatttgggtttgggaaaatgccaggatcagatccttcttctcctgctccaggacgagagaatcgaaggagttctcgcggaatgtaatctcggacacatcgtcgatgaagaattccatccagcgcctgttcttgagcgagtaacctctaaccatggggctggtgagaataagcagatggtgtgggagattctggtccctcccatctttgccgcggtttttgggatcgaagtcgtcatcgacgccagttcccatgtctacgtccataccatcatcgctcccatcctcacccccctcctccccactctcatcgctctcggaatcggaaccgtcgtcattgccatctgggcgacggccacccacagtgcccttcacgtatcctcctaagcggagattctttgttgtggtgaatgagagctcaggggtctcctgcgcccaagtcttcgcgtcaattacaatacgcgagtctaccatctcttgtcggattattttgtactttctatcataccagagagccagaccgttggagaacttgtaacgatgcccagcgaactcatggaaacgcaacccacgctcccgaagcagctgggttacactttccttctgggaatgcatatcgagagggaagcatgataggctttggactttcatggtgccgagatactggcgaattttttgcgtagctttggcccagcctaggatattgccatcccactcaatgcactggcaatgtagggcgtagaatttaccgcatttatcctttgcatactcgccgcggacaaacctgactgcaatgggctttccattcttggaaccccaaacaatacatccgggcgtgaagattgtccagacatgagcccagttaactgccctggttttgatgaagtcttcgcgggcctggagaacatcccgcagctcttcctctaggatcccgtgcaagagcttgagatggtctttggtgaggtcatcaagctccgggtcctcgagagcctggatgaagcggtcccagcggtggacgaaacactcaaatgggttgtcgaagacgaggcggacgacgttgacgacaatgccggggtagtcctccagcaccttggcgagtacgttcttcaggtaaggcgactggataaccagactgtcaatgaccagcggcttgctcgagtctgcccgcttgggtgcaactgataccaagttagcaagccaaatcgcatcattagctgcgtaaaggagcctcaccctttcgcacaatgatggccgacttccgagtctctttattctcggtagtctccacgtctggcgattttgacgaccatgattgccgtccagccttgtcaaaagtggcgaagagcactgtgctcaccgtggaacagccaacaggtgcatcaggggacccctgagcatcgtcgctcttgttggtttcaccttcgttgctgctggcggccgcttctaccacatccgtcgcactgttggtagcatcggttggcttcttttcaatggtgtctgcggtcattttgcctcgagtgtccgggacagatacaggaaggaggcaaagaagtgctattgcaaaggtgatatgagagtggaaaggtttcaatgcgactggtataagacctaggcttgattgacgggggcaaggtgatgaatcgcagaagatgtgagaagaggcagaagcttgggttattttcttggaggcgggaaagacggtcctcttaaatacacgaggcggaccatgccaattcagcttctaacgctggaggcaactgattgatggatggttgcataactgcaaggcgactgacttttaggcagcgaacgaataaaacgcttggaatgaatccatgccaccctccaacatacgaaaggaaccccatacggcaaccaacagtgcgtaagctccagtgacgatccaggctgttggctgcgtggacgaggcaacaaggcatccatatgctgttggctgtggtgaaatatttataaatgttcacaacgtacgatagctgatgactgaattaggaaaaatgtaccgagaatgattgattgaagacctgtacagagacgtgtattgggtgttgcggactgccattgcacacaaatcaagagaatctggagtatggggttggggaatagatcggcgggatacaccaaaagcacacaataatcaaataggtcgcatcggaccccgggaggctcgcctggagttacgttgcttgtcctgatttgccttatcccgtgttctaggcctatcatcaagacttagcacatactgcgagcaagttttgctgacaactgatgaacttccattgtaatggcttccttcccttcttttgcaattctggtcccgatccgcaagacgtactatagcaagcctcaaggtctcgctggagagttatataataggttgactcacctggttcattcgtcgcgctgtcgaagacgtccgatcttggtcaagtctaataaccgaaagccaaaggaaagccagtttgactcaaatcgactctagtacggggaatgctgcgattttactgcgtcaatcgttggctgctactaactggcgaatgctgcctggcactcgatgccgatcatcgcctcccaatgcccgttggctgcgagtgtgtggcgacttatcaatggaacactactcactggcaccctaacaaatgtgcctgtatgtcttggtagcgtaggattcggttcttgatcgcggatatcgagtatggctgagtacaggtggccgcatggaggctgggaggaatttggcaagccaaccgagtcacttgcacctggagagagcttatagtgcaatgatccggaatacagttattttcctcttttgtgttaaaatagtgaggcctcgcaccgcttgctcagcccagcgtctacttgctaacagggagctttgaaacctgcttcaaacagctatagaacgagtcacttcaatgacgtagcattctggatcagctgtgacgcctatccatcactgtgcccgaatgtatcaccagaggcctttgttccgggcctcccgttcttcactggtcagtatcattggctgcccggccatgtaacagccaccgcccatctccactgtttctcatcattaatcatccaccttgcgcagaaaactctggcagctcagccatcaggccacgaagtccttttcttagaccagactatctgtttgtcgggtgtctcctagcggcgctattgcccttacccctatctcagccaggccttgcgttgtttatcatggactcgccatcttcgccgccgcctggatcttaccccgcttctcttccaccaggatgggctgctcagtggaatgagcagtacaaagcatggtgtgttctatacgcaagagtcgaaaggggagtgggcttcctactaactatccggggctgtcaggtacttcttcaattctcacacaaatgtttcgcaatgggaccatccggggtcggcccagcaggccagcagcgaaccacaggtggccagcgattcacagttggctgacgatgaggcattggctgcccgccttcaagccgaggaggattcgcgggccacaccgcagctgaacatggacacccatccctataggggaaacaggggcatggaagatagcgacgctgctctcgcggcgagactacaggcagaagaggatgctctcgccgcccagcagagatcaccgcaaccgcaacacccgtattcacccaaccacttccaacagaatcctgcgttctctcctcagcaacagcagcagcagccatacggcggcgactatatggcgcatcagcagcaaccctaccaacagcaaccatacccacagcagcaacaaggatttggtcttcaaggctacccgcaatatccgggctatcccaaccagcagtacgcgcagccgcaaccgcaagcacaaacgaccagtggccaaagtggagggtttctggggaagctgactgacaaagctaaaggacggttatctgctgccggcgtcaacctgcctgcgtctagcagcggtggaggtggaatcgtaggcttgggcaatagtgccttggctggattcaaggacaagctcaagacgaagaataaacccagccaaccacagaacaacaatgccaacagtaataccactggctacccgatgtacggtgcgtatccctatgataacggaggaggccatcatggcgggcatcacggcgggcatcagggtggacacaacggcggcgggcatcatcatggcggggatggaggaggtggccatggtggtgatggaggcagcggaggtgtcggtgggggatgatgagtggatgaatagttgctcagacatcgggatcatctggacgctgtgttattgaagcttgggatctgggagacggtctgaccttggagttttatacacgaatgcccactctgctatttttccatgcaaggcgacatagccatatgaaatcgttcaaataacacatcgaatgcaactcgagaattcagttttctgatagcaatacctcggtttaaaggtgggattacccagtaggaaacactagagatgttacaggtatttattatcccaatgtgcttgggaaactcatcttggcaaagccgtccagacagcatgaacacagtgctcatgtaacagccctcattgacaatatctcctcctgttaatcgactttcgtcaacacacctcttttcctcgtattctattcctcgtcatcggtgccgtcacggtcaacgggatcttcgtcatcaacatactcatcccaacgattccaacccagctgggcctttcctataaaacgtagtagtttggtgcggtcggcctcgatcatcgagttaaataatgaatcaatcttcaaatcaggctcccagggtttacctccacacgctgaatcgtgctgataatacaacgtaatcctgttgtttgttttctggtctccgtcgctcatgttttcttgtaaaggtaacggataggcaatgagatctctgttggaccaggcctctgggcttggggtcctatcttgccactcttcttcacccccgaggagcggaaacatctcccagtgaatgtacatttggggtgatggatgcaggccccataaatggacgaccaagtcatatagtaagtccattcttagcccatgctcttgaagcacctcaacttcactcccaaattttgcgggaacaggactgcccgttttgtataggcagtagtcatgggtataaatccggatctgctctagtcttgccggtggctggaccgggaacatgcgcctccaggaggcatcaggacgcaagacgctttcgtggcggtcattcatataccaatccatagtgccgcacacaatgttgtagaagtagtctgggcttactggccggttcagcgagaagaatgtcggaaacagagctttgagaaggggattctgttgcggcatctcgctagcagggcttggtgtgaagaatagtttttgctgtatcgcatgggactgcgagacaacattcttgaagtggctgccgatgagctgggacaggagaaggtctctgtggtcgagatggaggaggattgtttccaataactcgactgcggagaagaccttctccatggcctcatggccattattaacctccgggactgccatcgtagagaatcgaaaatgacttggaccatggatgggagcttggtgagaagttcagaagaaatccttgcccctctatatatacacaaaaactaaaagaacatatcccccggcaatactacctaattagttcttgaccatgcagaggagcggtgctacgtaggtgtgactcatcatgtcatgctttcagtcgagtcagatgcgattgaccaccccagcaatattgattggctccgcgccaaggatttgttcgcagggcttttcgcgcagcaatttgcgttgtaccctcatgctacccttctagggatggggtctcttatcgaaaatccggtagttcaaatttatgccattcttagacgcaagaaggaagatgaggtgaaagcaggatggaggtggacagcccgatctaggcagctagagaaactgcttactttgttccttcgccgcccgtagtttgccaccgtcgcggggaagtaggctcgtttctacagccccgatgaatgataggtggccagcccttgtattttgggagggagataatagagtctctttaagtatgcagaccagcagtgccacgacacgcaggtagtctgctcaagtatatatcacagcgagagaagggattgtgcagagatcaatcattaaatttgtattctcacaccaatcccaattgctttatgataactttcagctttatatctaggtaccaagattgagggataaacgattcgataatatcggtgaatcctttgcgcccctggctgataaaccgcgcatgctatagaaacttgctagttgtattggcctgaccaaggtgaagtgtattgtgaaaggcctcgagtcattggcgaagtaggtggcagtgcgcgttagtcactcttcaagggggttctggcaaggcagtccttctctgtcacttctttcgctcagcaagctgattaaacacaaggaattgtgcttggggaagggcctgctgagaacagtttgaatcaatactgaaggcccaaacttctttctatggcgccggccttcgtgcgggacggtaaacccaacaatgccatctatcaccgagacatcctgccaagcttgagcaggtcaggttatgcttgggacggctgtcacactttcatcgagaacagccgtctcagaatagaagcttgtgggccagatttgatcaaatccctagcttgaaccgaccgagcttgagggaaccagcgcatcacagcgccagccacggcgtatgaatctttgggctgcgagatgacacgattgggccaccattatacatgctctggatgggtggtacaagcggattcagtgattcagcgaccgccggttttcttaggttcgccatgtagcctgtcgaggacgccaaccgtagatgacatcagtgtggtaaatggcgtgtatgtgggctttggctcctccggctccggggattgagaacgtgtcatgagtggaattcggccctctgccgaggacttatgattgcccgagagccctgcctcctctatgcgggcatctttgcgtgcatttcgtcgacttatgtgccgtccccaaagtaaccctatgaccatgattaagaagaggagcccgaaaaaaccaccaacagcagatccaacgactattttgtctagcttggtcttgagtggctttgctcttgggaatagggggtgctcattggtgctagtggcactgacgagtgtcgagaaggaattagagaagaagaggagggttgaaagactgcctacgcggatggccattcttcgatacaaaagttgttttggacgtagcttgtgtgggggagcttgtgctaacagttccggaatgtggaaaagacacagcttttatgttacttatccaaagcctccatgcattgaggcagcttgaactcgaagagcaacgccacacttgggctggtctctaggctgatttcccatgccaagcttcatcacgagcaatacggaggtggagcgaagcaggggctttgtgcactaagtgcgtgttagaatgtcactaccacaagcctctcccttaccaacttagcctccaaggcttatttatttctttatttctacagacagcacctcaaagatgcaatgaatagttggctttagggtattcaaaggaaacagttgttgaatgtagagagagtaaaggagtttggaaaactacgttttggattggcttcacaacgggcgaattagctgcgctgtatttcttacacaccacttgccgccccgtagaggcaataagccgagattggagatgtttttccaagtattctccctgtcacccaccacatgcacctcgcttaaatcaagctattgacaaggatgtcatttagggctgcaaccgagcataaagaggcttgtctagtgggaacggggtcagcctttgttaaagtacatggtattattcattgtgttgagatgtcgggttctggcgtcttctattgtttgtcttaaattttccactcaaactctcccgtatggtactagccatccatcagtttcgggacctaccagggcgctaactagataaataatgggagagaagaactttcagaggtattgatcatgtgttatggccatattactgtgctaaaatgtcaaatttacattttataggggccataccgccaccgcttgtggttctcctccacccaccatcgtgtcatatatgcgccctcctccacccacttggcaacctcctcaccatgcttcgcctccactctaccaagaaaagacaagaagtcgatactctggactgaatcttgctctcggggatcggcagtgaggttggtaaacctccactctacgttcccgacgacggggacgatgaggtgccagtctggatggcttgggtcgcgtgcggtgagcatggagcgtcctgggttggcaacgttgtattgccattggacctggccttgcctttctgacttttggggcctaatgagcgactggccttcgtagttcttcagcaaatccgttgcgacttgacgagtggtggtgtgaagtgaatttgtctcgaggaggaggtcaaggatggttggtagaatctgtgacgatgagacaggatctgaaacatcaaaggctggtagcttggggtgggataagacgagcggaatgtggtcgttgccaacgttaggattataataagacgccacaatgtcattctccggcatagatagcccgtggtcgccttggaatacaaccagggtttcgttcgccacaccctgctcgtcgaggatattaagtaacttttgcaaccatgagtcgatgtagccttgggcattgatataatgagagagatcgttgagaccgttggcgacaggtatgtactttttgtgctgtgggatgccaaaggggtgatggccagtgttcgttaggtgggtgagaaataccctttcatctttctcttttgcggaaatgaatgcatctcgaatatattcggtgagaggctcttcttcaaatccaaagtaattcacatcgggattatcaacgcgtccatgtctcgcatggtcgcttcgtaagtagtttcgatcaatagtattctgtgtgggaaacccaatttttctcatcagttccgcattcccatcaaagccgattgtggacgttaggaagtagtaagacttccacgcagaggatgcgtagggctctttcctatcctgctcagtgtcctgagcattcatagcgttcaggatatgaggcagacagggctggtagatgtggtgccggtagtccttgttgaaatcggcgatcaggggcgcgacgccgcaaagtgtgccaatttggcttttgagcgtgtaggtgctcgcagtctgggcgttcgtaaatcgaacaccaccgcggtggcgtttctctgtgtgattgaagccatcatcgtagtccccggtaatatagttggccgttggcgttagagtagacagtttgtcttgcacttcctttggcatttcgtggttggggaatgtctgagccaggcggttccataccattccatctctcttaataggaaacatgtcgttcctcgcactctcgagaaatacaacgagtacatgtcttatcgagacatcctttaggttatcttgcaaatgagagagtaatggctggtcaagatttgatatcttcatcgggtctgatgttccattgtaatgcgatttgttggtgtaccaatccccaaaaccctcaaggacgaccccctgtggaagccatggtaatggaaccgaattcgtgagggcagatcgattatcccagcgatgctggattcccgtgtagtagtacggttgtagttggtctaggaggggcgaggaagatgagaaatcaacaaagggtaatagtacggtagcccatgagacgaaagctagagagctatcgttgggtctggtcaataccagtacagccaaggcaattagaccggtgacgatgaagcagtatgctccaaaatgcaagatggatgacagactttgtgttggcgtcgaggtccgctggtccacttcatccaaaaacttcagcagccgctttggaaggaatgggtatgtttggggacccaaactatccagttccaatcctggttccctagttgatggtttgttcgcatcttgttcagcccctggctgggaatgttggggtgatttggcccctataactagagagcaggatgtgcgccaaatcagtaggatgagccagtccacgatattggcagtgaaaccaaaaaattggtagatgacatcctgcagtatccaaccaaaagagataagaaaggcaacaacgatagcgcatgagaaggcgccagataaaacaagcccaagtgacgagccacctgtggccaggccgacatccctccagcggatttcggaccctgtagttatgtgaaaggttaaagccacaacactgagggatatgctgtagattatgatgattttgttcaaccaaataagaaatggccttgcgcggacgtgtgtgcgggagcgccagtgttcaatctgcaggcgtaggataatgagaaggaagaggtcttgggcgaagaaggacgagccccatactaccaagtgcttggtggagatagacgacaagtggccgtgaatataggcaactttagtgctcagtaccgccagagtggtgatggtaaatgccgtcttggtgttgaggaaggatgagagggaggccttggcgagccaccgtgggagcggccgcccagtcaccccattcattttggccggcaatggcccgacagaaagacagagactaagaaagacagtccggactgactgcctattccttcatggttgtcttcgggtgaaatgagcgttgatcggcagcttagtcccggccatggaaagccagccgtcaacagtcaaagagtcacggagaaatcgagcaaaagggaagtgaacgtagccagtcttgggctaagttatggttaaattcaggtgggaatattgctccccctcccctgaactagacctaatattgacgccaagcattacttctgcaggaggctgtgctgatgagcgcaacttggccaatgacgcttggtctttgttcataaaatgtcaatctttcctaaataagcaggcccggtttcgtaaagccggtcggctagaacccgggtttagtacaaggcaagaaacacgaaaccgttgcatggcgttgtaaaccagtcttagagaacttctaggaaccaagtaagacgcgggcaaacctcagttacgcagataaaacacgcttttaccagttcaaacgcgcataaagttcattacaaggcctgtcaaaacacacaacaccatctccccacctcatccttccaataatgctacgccaatttattcctagggtcgcgactgatcaatggaggctgtactttacgcgtaggccaatgattggcattatgactggcccgctcggggtgaatgttcattcccccactgtatcaatttatttatcatgtcgattcaacattcttcttacgttattcaaattaatacatggacttttgttgattaactacaacccaaaggtatagagcccagatcaaaagaacggcgtatagatattaggtagtcaaagtagcgcacaatagaagataggccagcgggcatgcgacatctacgcgcagcgtatagcaagtacatgttcgtcgagaggtcgccgttctcagattgctcaagtctcagcgtctttctgccatggggaacaggcccagtaaactctgaggccctggcgtcaagtcgataaatttgtattgctggtcaaggagtacacgctcagctgatcctaccacattcctagggacctaaacggcactcttctgggtgcatccgagaagtcagcatgttttcatacgcgtgatttctcagctgacaatcaagcttgttcttctacatcttaggtaattctacaaagaggttgcttgcatcatgggttgatactcatgggagcagccggccccatgtttcttgacttgtatattttgattctatgtctcataaagccggattggtagttgcttcaacggtaatggctgtctgcctacctacttacaacaaagcatggtttcttcataggagcaagccctcttcatgtactttcggtaaaagtgtcttctattggaaagttgtaccctagtctaccttaagtctagcgattccggagttaaaggcttcggccagaacctcctgctagacaagatcaacagggatatattttgtccagtctcccttcgcagccaaccagtccagtggctccatatgctcgacggccccgccgtatggacgactgacatagtatccgatgaagcgctggatttcgggcgagaaagtctgcaccacatcgaccgggatcgcaacgtactgattctcctgttggcggcaccatcccggggtggcaaaagtagtgagaagagtgctggtttcggtgcccgtattgggcagctggccaagaaagactgatcctaagctgttcatgtgttagtacaattggaaaacgagattaatgcaatgaaggggctcaactcactggaggatagcgtcgcccttggcaagctcgacaatgaattcctccttttcctttgggtctctgctgtccttccactgattcgatccaacaacgaccctcaatgcgccatttgagcgagtgataggcgtggcggcaaaactgatcccaaagtctgtctctcttttggcaggatggacagtgtgatgacagtcgtcttgccgtcgcagaccccaaccggtggaaccaggtgttgaggtcagggtggccgttaaggaaagctgaggttcggcggtcgagactgttcgttctgcctcgtagaagatgatgcaagtatcagtgaggatccgcttgacgaggtcatggtagagtttgttcatcatgagctcctttacaaaggttgggctcttcgctgcaagaccgaaggattgtccttcaggtagggtgccggtttctttgagcactgcatcgatggtctctggctgggcagcggatttgatgatggccactccgtcagctttgagggtctgcagaacatcgtgggcctcggcagatgcgagaaaggtcttgaccgtagcaggcattgtagcttaggccaaggaataaaattgagaaatatccagaaggtcgaattcttgcttgttgggtggatagactcttgtgtgctgtgaatctgttggtgcgatgaaggctacgacaatatgcttttaatacaaatgaatacttcatttatcttgaacctcaaacttcagttcaattactcacgatagagccgatccgatgaagatccgatgaagatctcacgtctgataagcctggttgggctatctaatacccgttgtacttcctgtgtggagatagcctatgtttaccgtttttggtttacttctcctatcgccccctcgcttggcctatcgacacgatcggccaaatcactttcggattcttgctgagaattttgggaatgccggattgagtcattgtcttctgttgttggatgcaactcagcttgaggctatataagtgctttgacttattgctatgaccgatcgatgaggaagcaacagtcaaccttctccaattgaatccacgtaacttgtttcgatattttcgtctcaatcgactataaatccttcagaatgcctaacccagtccaccaaaagaacaacccggaggttactatgctcgatgcttcctccccaattgaggaaatcgtcaaagtgattcgccgagatggaggaatcattatcaagaacttcatcacccccgaagacgccgataagatccaggcagagggagacccctactacaagcttgtgggcaaatacgaaggcactctgttccccgcatcagatcctcctctgaggtatgatcaaccgaagctgtgcacatcataactgggacttgttcactaaccagggccagtggatttgcgggcaaatcgcctactttcgcccataaatgtctcaatcacccaacataccgtgaggcggctaaagctctccttagggaggaatcgtaggtgtccgatataattccattcgacgtgccactaacggctttccagctacccctatcgagatggtaagcgctacaaatgtgtctcgaatcccgttctggctgtatcagaggccttttctcgggggaggtcggatgcccagccacttcatcgcgatgatatggctcagcattttgaccatatcgaggggagtggcgagagttcccttcttggattgcttgtagccggaaccgtatgtcacaaataggatcttgtccaccaatacggggagtctccgcgaatgctaacattcttctatagaaatgcacgtttgagaatggggccactcaggtcattgtcggatctcacaaatgggccgagggtgccctcaccgggcccgctgaccggtctctctgctctacatgcgagatggagaagggtgacggagtctttattattggcagcatttggcacggcgcaggcgccaacgtcactgatgagcgccgcaacattttttcgtgccacatggtccgcggcacgtaccgccctgacgagaaccaatttcttgccattcctcgcgagactattgagacgtatagccctgaggttcaagctttgattggttggtctgtcagtcaaccgcacctcggccatgtcgagaacaaggatcccattcttactcttggaagcaaggaagatccttttggatatggcagcatgttgggagagcttgtttccgccacaccagcctgataaacctacctacccacgcatttgatagcaacgagatctcaggagaaatcaaaattttgttggacggcggagataaagcgagacgccagcaaggagtatttatcactgagtaggttttctataacaagatattcaattccagacccaactctttcaccacatctttccatggtctccagcctctttcatcaatacagtcccagatcttgttcagaacaagaaccaaagacagaggtgcttgaaaccccagagaagtgtgcattctcatcagcccgtctcgatatatatctctgctctctacagtcttcgcgtggactgcgagcataaaaacaggccacatgcatgcttggagccatgataacttctgcaagctatctagcgacttctttaacgcctcctgtattcgatgatcatccgagctgagggcatagatttcatgatatatgtagcatagcaggccgagcctccatatttcgttgaagtggtgaactgagtgcatgtattcaggcgagacagacgacatgtcagggtgccaattcttgattttgtccaaaagctcagctacgttcaaggtggcggacagaagctgatcagtgctacctccagccatcctgagtttgtggattttcacagcaagatctgcagattcacgtagcagcatatgcatcttccagtcaggcatattagcccaccagtaagattgatgaaaagacatgtcaatggtccctggcgatgcctcgcaaacctcatctggactccgtcaatgactaggttgaatagggtaatgttatgagaacttacctccgtcgatgcacttgatttcctcgagggactccagcggttcaatgccaacaagtagcgtccggcccattgttgccatccaattgaactgcattagtacacatttcttgtctgtttcaacatcgccctttgcctcggctagtccgagcttcaacagtcgcctacaaccaaccagtttcaagctccatgaatcgagtcctgttccgatcacctactcaagttagtcccggatacttcaaggaaagacaatatcttacgtcaaatataatcgagagcatcacggtcaacccgagagcccaaaatcctcgccctttcttcaaagcttcccgaaacgagctcttgatttccattcgaaatgatttcagcgtatcatttttcagatgtcccagtttggagagatgcaaaccggacgcgaacaagatggtgtccagcaatggtttagattcgatcgcgagcgagccatacacttttcgatatgggtttcggaccggttccactgggtataaactgagggagagggtatttatgactttcaaagtaagctttcgatgaccgttatacaagtctgtgggtttcttacaatgatggaataagcgatctgttagtagtcctccaggagtcgtgattctgagaggccggtaagggcttaacctggtgcccgtaccggcagagataataatttccccggcttcttcacggtcatgtaatgtgaacagagaaatagactctgatgtgtgaggatcgccagtaaaagatgcgcccagcgttacctcggggttgttgtattcgtaatcgagagattcctcaaagatgttgattaatggctggtcgtggtgcatgttctcttccttgtcagatatttctggcagcggagagttgcccaaaggaagtattgggagtggactcgaagtctcgacttgaggcacctcttgtggatcctgagactccgttgacgggaaacaaggtatattccctgctggagctgggttcttcgcactgtttggcaatctggcactcctttggctcgaacgaggggggcggccccttctggctttgccatcagcacggccgacgcgggtcagtttggagaccatatgtccgtcagcgctactggagatcgaaaactcgcccagctggatggcataaccgccgcattggactcctctcgaccgacagttgcgacaacccggcttttcctcgtcgcatttctggtgtctttttcgacacgtccaacaacctttaatgtgtcagtcatccagaagggagtggggagggattatcgggggaagctaccatgtctggatctggtactgctcatgattgtctaatccgcataaactagcgaaccaagacccgaaactggaaagtgcaaggatagttggatctcaatctttctggcgtgattttctgatggtgagagaatgaaggatgtcgaggacgggctttatcgtcagggtatgccaaaggcaccccgcaaagattgcacagaatcacttgctgcaactcttccccgcgtacgcctacatcggatacagtggagaatagagaaaaaaataatcatgtccaacatgattggcttgagtctgccgttacgcgacgtcgtaacgccctgtcagtgttatctgagccacggtaacccgctttgccaatcagtaaaccaagcatgagagccagcctggtctgctagcgtctcttgcttccccgctgttgttgactggcaatattccttatcatggttcctgaaatctctcgtctgttcattggctggacttaagtgtgacttgaaagatagccttaacagcaccatatcgggattagctcatatctccgtatctacgacttggaatggccggctgttaccagagataaccgagcgaataaggctcatcgcctacgtccgggagagccaccggataacgccaggagagctactcagcttatacctaatgaagatggtctacactatcagacatggctttccgagtatcggattggccaagggtgtagagtaccaaggccttgtatgagaaaatgtgcctctatgtgcaataattttcgcgataacacgattgctcgcatcgcacggtttcccaatcgatacgtgagactacgttcgggataagcatttttgtattaggtttgtatgggggacaaccagaatctgcgagattggcacatagggtgtaatgggttcagcgagcaagtataaggactgacacaatcgctccatatctgctgaacgacaggaaatttgccgtcccctcgaaaacgattactttcaattggaacgcgacaaaaatcattatgtcagaaacagaagttctaacaaccaaaacccatctcccgagcacatttgggttatggagtggcatcagcgtcggctggctcactgtcaacgcctttggaggactgtcgttcatcctgttcgtcagtctctcagccggcgggctcccagcccttctatatggatagcaagtacctctttttattgccttcacataacaaaaactaacatgcaaggtcagcatcgcttcgtcggcatgtgtgttgtgcatcattctcgtcttctcgcaatgcgcagctagattttctacggccggtaagtcttggttcccctattgttatacctcaagccatttcaaaagctcacaacagttgtaggtggcgcctaccattatgccgcattcctgctgccggatcaatacaaacgctcagtctcatatcctctcggctggctcaactattttggatggattttgacccacgccgcttgttgctccatagtagccactgctcttctagctctggttaatctatttaacccgagctttgcagtcgatacccgatggcagctttttctagcatatgttgcagttgcctgtatctgttggttggtgaatctgttcgggctcaagggtattcccacgttggaaatcttaggctgtaagtctccaacattggaattatgaatatccgaaagtactaagctgtgaataggctgggttaccgccctcggttttgttggattcagtgtcgcattgcttgtcaaagccccaaaggcatctgcggcgtctgtgtttgtggaagtgaacaacgaaacagggtatgattcaacattcatgtctatatcatgatggtgctgtaggctaatctaaatagatattcatccgccgcgtttgccgttgtgttgggcttgatgaattcgttcgcaaccctcatggggcttgatagcccaacacatttagcagaagagctccctcagcctaagagaacgctgcctcaaattctcatcgtggttattctgagccaatttgtcgttggagttgtttggatccttgtcctgggattttccataacagacttggatgctatcctcgccacctcaactgggtatgtagtctgcgtttgtaaggccatgacacagcttcattctaaccatcatatagggttccgatcattgaacttatcagacttggtactgatagccaagcggcagccattgtattcaccctaatcttaatgattaacaacggtacttctgctcttggcagcgccatcaccatgagccgacagggctttgcatttgccagagatgagggattattttggaatgacaagtacgtcgagctaatcgtagaaaaaaagcaaattggtgatagtggctgacggttttgaatagactcacggcgatttcccccaaaactggcttgcctgtttggtcgattacgtttccttcaattgttacccttcttattggtttagtgttcttgttttcgaaccaagcattcaatgcgattattggcgcccaggcgatctgccaaatcatcagcttcggtgaatatagactggtcttctcaatgaaagaagtttgagaagcgacatctaacatgtccttgacaggtttccctgcttttctcttgctggtcaccaaatcttctaagttgcccacggccaagtcatggaattacggcatgtggtcgactcctatttacgcgattgtctgcgtctatgctatgttagtaacggttgtcgctttcgtgagtataagataagatagcaccagatgctgaacttggctgacttataacctagattccccaatcatctccagtcactgcttcgaatatgaattacgcaatcttaatcatgggaatcttcgccgtggcaatggttggtacttggtaccttgtgggtcgtcacagattctcgcctcctctccttaccgagacgtttgaagaaatcgatgtgattcagggcatagccgatgaggtggcatcaaaggagggctccttgaaaaagacagctgcttcaagcgttgaccctgttgtagtctaaattgtggtttggaggagatccggtgattggtagtttaaggacagagcacagagctatgcctgatgtggcaatgagttgtgggtttgtgttgagttatggacgaagtaagttgtataagagagataattacaagtcttagtagaccaacatttgctcattgaccaagtcttcattgttgttccttgcagtacaaacacagaatgttggttttcccgcaagttaaaccaagactctactttaacaggagtcgttatttaaagaatagcgacttcaatctaacatttcaaattgacgatctactaacatgtttccctcatgcaagaagcactctgtcttcaaattggtgtcttgaataatggcccgagccttacaagataggtttgctagcaggttcgggctttgacctgggcgcccaccctaattataccgttttcagttaagatagcctaatttaaggatgtgatctcctgacactatcagctttcaatatcccatggtacgtttctgggaaaggtgcccgcatcacgccacccaaccaccaagctctgggtttaaatctccagaatgtgctagtagtataatgggatccatcagtcgatctcttttcgaaatcatttccacttatcgccatgactaattcatatattatcgctatgcacctgtgcagggaaatttcacattctttggcgcagcccagcgcgtcagcatctcaacgatctgcagatatccaaccactgaaatctaaggaacaatcatcaaatttaacgacaatggatagccaaatatatctgaagcagccacaaaatcaggcggtgaagaacgagtgaccgccaacttgtttatatggaatgaaagcggtatttctaaatcaatttcgctcatgtatgtgccgaacgaaacctcagttcatatcttaagcgaatttttgctaatggagcttgaaagaatcatattataagcagagtcagcgacttttgaacggagtaggggaaaagggggaaaagaaatcaaatttcgtataagcgagggacaagacattttatctatcatgactttctcatacttatcgttactcttaaaataaagcttgatctcattttaagaggtagactttccttccccttcataatctacctacctagatatagttagtacttctcaggatgaaactagatactactacaataccatcatgcaccttagggtaaaacagtaaactaaaatttgatcttccatccaagtcgaaaaccagaattcaggttttttttttccttaatggttcttcatcttgtcacccattttcttctcttctatttcttaagctgaattatcagcttcagccttccactcgctattcctgtctttaggcacgcggacgaacaagaggttgaggaccaatgcgatgactgtcagtgcagcgccgaaataaagagccgagcggaaaccccagagctcgcttgcacctcgcctgacaacctcaacttctatagtgcctgctatacctaaacccagactgtttccataaaggttgagggtcccaataagactaccagcgacaccttgctctcgcttgccaacactgttgctagcaatgatctgagcagcgacgtagacgagatcagggcacatgcttgcgaggaagattgccgggaaagtctgtttccaatacagctgctgtgccggcatagtcgccagaagtatcaacgatgcgagggaagtaaggacaccgatacacaggatccactgcgcttccagccggggaatcaatacggctgcgagggctacggcacaagatgcaccgacggcaaaagggacccatcccactgctgtctcaaggacagtccagcctcggatgagctgctgccacgcgaccatataccagaggaaaatcccaactgacatgtaagtcaccaatacgacgatgatgagggccgtgaaggttggtgcggcaaagactttgaggggcatgatgggttctgcggcgaacctgctttcccagacgaagaatgcaccgagcaataccagagatagtgctgcggtcgcaatgatgtacggagtattccaacctgaagcgggtgcttggctagacaatactgcaattagcaatcgcggagggtcttgaggaaatcgggacgcatacttccaagcaaagctgaacagaatcaagccacccagaccaagtaaaatgccaatgaaatcaatttttccatgcttatcaaccggttcctccttaggtagtaggcagaacagtggtattactgtggcaaccataagcagcgaactggtgagatcttcttgtcagtctcccatgctctcactaacagcctatggcactcacatcacaataaaaagccatttccaatcaccctgatccaagaatacgccagcgaggagggccccgatcaaggcacccactggaggtgaggcagcgaacaccgcaagcgtagcattgcgcgttaggcctggtgggatcatgatcattagggttgcgacagcgttgggcatgaggagccctcctccgataccagacattgctctcatcgctacaaatgaatcatacgttcggcagaacgctgtcgtgagcgagaagagggcaatgctggcggctccgacgaatatggagttgttatggccatacacggctcctagtcggccgctgatcaagaccatagcgctttgtgtgagtctgcaataacgaaacagtcagtcattagggaagatcagtgagagtaagattggaaacagacccgtatgcagcggccatccagttggcctttcctggcccgggttcgacaccgagacgtttgctaaattcgtagcctcctgctacagtagtgaacatacatgtgaactgtgcatcagatgtcagcgtaagcgttgatacaaagcatacggtggacatacttggaagaaattggtaagaacaatcaagccaatgattgtccattgtcgtgcctgtttcagaggaggaatggcatcgttcgctgctgttgaggctaggagatctgcatgggtcgcagtagtgccagcggcagtcgcagatacggtttggccaattatagcgagaggctcttctgccaccgccggaacaatctcttctatgaggtgtcccattttcggtatcttcttgttgatggtgcctcacgttatgctacagatactgttcaacagcaaacctcagcgtctcagtacagttgataagaccccatgatcgagactaataaacgaagaggcttattaatgggagatgaagtttactaagaaattggttcgatgaagtccgagttccgaaagaagtatgcctaggctatatttcattagcatctattcgtgatcagttttcaaggggcagcctcgagttagaatgcggttggagaagtgcttaggctgtttattcccaatgtggttgggtttgcctatcagcgctgggacggcctggtccagacaccattccatggaatcttaggctaggccacctgtttctggataaatctacactgccttggacccttcgctattcattaactcaaaccgcattaagcttcttcaaggcgaaatatctggcgagtagcgtagttgtatttagagaaggataagtgcatgtcttacaatgatcgaataatagggagaatacatacaagaacggcagacaatggacggcaacaaccctgctgctcaattttgagaatgaaactcttccatcaaaccctcgcgactggcctgtctcctaagattgattacatttcgtttcggggctctacagccttagcctgccgtgtcctgcaggtctcgtaggcgggatttggatactcgctcttcatgatgatggcaatgcacgctagaaggcaacgcacttggttcattcttttcattacgcgactgaaagaagcgcaacatgacatacggatgtggggaggggagtgcggaatgtatgttccaccttggcggaatatacactccgctgctgatccgccactcatggtattggcatcatgagtaatgagcgatgggtgtagcacaggccatagagataaatgtagtataaaatcgtgcttgggcctccagcctatccatgcaaatcatcttctccgttaccttaacccaactcaccagctcgtacaccatgtctatgaaacagtatgcctacagaggcttcggcgagaataaccagagagactactggtattcgtcaaacgtccgaaccggtgatttcattcattgtgccgggcaggatgagcacgttaaactctgaacatctgtccacatcggctaactctatgcctgataggaagttacctcgatgagcacggcacacaacccaaggccatcgttgagcagatcgattaggcctttgtcaacgttgacatagctctcaaggatgcgggtggcgctggctggtcacagatacatcgagtcaactcgttccacgtccagctagaccccgtttcacaagaagcgatgatgcgcaacttcaagaagtggatgcctggcaaccatcccacttgggcctgtgttcatgttggtagactcggcggggataatatgtgggttgaaattgaagtctctgctttttgcccagagggagccaagagggagggaaccagcaaggcttaggggggtcacggcgtatctcaagaaggaattgaacaaacgtgctaacagcatgattcgtaaagatgctcaaatttgtacctaatacatccaggatatctcatcttcacgcctatctgtccggatcgcggcatggtgtctcgccctaccttaggcagcatctagagccacaaaatgacaaaggacgtcacctctgcctcggtgattgacaatatcagctcctcaccactttgctcgatgcccttctccaatgcattcgtggtcaaggcctcgctatcgctgcgtgctatctctcttccatcacgagagagagtccaatcacccctcccgaaaactctagaaatcccaacttttcccgtcatctcgggctcgtagacggccagatcgaagagcaaagctcgccgtttcgaatcatatactgcacgataaacatcgatggaaaagtcaacgctggtcaaggctggttctccgtaatgatcgcggtactttggaccccacggctggtcgtagaggcgcttcagtccgccagtcacgttcaaacgggaaagtggaagaagtgcgttggactgaatcggggagttcatactgtattggccgtgctcgtcgaagatgttgtcatttcgtgggtacaacaaccctccatcctggtaacggggtcgaaatttattgtcagcgtagtccagaagtcccttcagtgtggtttcgtcacccatctctgcagccagggcggcaaaccatccaaattcagcaccttgtaacagcaaggtggtgttcttcgactgtccatcgatgatcctgactttgactgacagtgtaccgtcttcgtgtcgaaccagtgccttcgtgcgctgccgctcatagttcctttccacgaagtctgggttccacgagtgcatcaagaaagcacaccaagcatccatgcccgttccaggactcggtgccaccatgttgttatgcctggcaacaaaaagtcgatagcctccctccggctcaacggagccgccaaaatcctcccaggctttaacatatcctgtggtgacctcgtcggcggtttgactgccggtgagttcgtcgtttaagcggaagccaatgatgggtggttggttgcagatctggaacacgcaccagggctcgcaggcgacacccagatatccgctctcaaccatgttccaatagacccgatcgttgagcgaattctggtcatactcaaaactgaatcctccaggttcaccccagaagaacgggtcgtacctcagcctcagtgacccaggctttgtgtagcgatcatcctcaaacaagctgtggtaaagaagggtcattgtttgcagataggcgctatacataatgttgtctttcttaatggggtttgcatctggctctttccttggtgtccttgcgagacccccgccagtgctggcatcgcgccagtagaaccaaacatctggatggcacatcttttcaatcatctgctccatagtgccttggaacaatccaggagccgctggaagcctatgaaagtgtgccaacgccaatgcatagaaaccgtaggcgagctggaaccggtaagcaccaaacccgtcattcaggtctgtcgggcccatcatgttcgaccagtcacccttgagctgccgagctaggttgccgatatgtctgatgctggcgacctgtttcttgtccaatactttcaagctttcgttgatgatgttatctcgaccactttctatcgagggaacggtgttaataacccgatccgttcggtgtacttcatccatgacacgcttgagacgggacatgacctgagtgtcgctgaggctgtcatgaagatggtccaccagacagccgtcaggatttaatatatacgtgatggctgtatggggaacgtcataattgtccgctataccattatcacgctttctattcgcgaatgctcggaaacccctacgagccgactcaagctctgcctgcgtgccggtcaagccggtgaagtgaagagcacgccctgccagaaaagacttcataacttccggcgaatcccgatctgggtctaccgagatgtacaagccattgagttggtcggtagttagtttcagactgttaatgacagctgtcaggcgggcaagagctcgtgggcagacaacggcacagttggtgaaaccgaagaagacaatcgtcggcttgcctcggaaggttgtttcatcaaccctgcgaccgtcatgatcaatcaaagaaaagcaaggcttgagaaattgattctccatcatgattattgctgactgtctacggggatggctttggaatggagaaggatataatattggtcggttcgttctgtcatttatacacaccggtctgccacaacatccacggatagggcggtccgatcaacgcttccgcggccgccggtcttccgagtttgttggaatctgttagtgatttttatctaagcggcatactgagcggtccgagattagccgtgagactccccataacgtactaagcaacgggctatgcttattaaactccgtcgttatatccttagagtcactggtcataataactccgtctctatatccttcgagtcaatatgtctaactctagctaagtatcgttaaagcactagtagtgcactgatcagggaggtatatggtctaatgttctaggcgaaggctcttaatactgttttgcggttcggacattgtaattatcggaaccagtcactattgtgattgatggtagagaccaccatcttcttgatgtcttaaggtaattcctcaaggccagtcccgatcacagccccggcatccatggctgcttgtggtacttccactgctgttgtgcccattcgaacttgatcagcgtgctgaccgcaccaaaatcggcctgtggtacgcttgaggatcgcgtcgctgactgctgtagcgtattcctcggtatccatcctcggcatcccatcaccaccctgggcgcgattggcaatggtagattcaatcttcttatacaaggaattctcaggcagcttgaaatcgccgaaatacgtctgtccccttgatttgaccccgcctgttaccacttccagcacatcaacaccaaaaggggccagttcgagtcgcagtgtgtctgccacaacttccatgcctctttttgatgctgaatatgtacctatattgctttcattagcacaaactctgtagggagctgttatggcaggtgcaattacccatgtagggaatgttcagataccctgctgtagaggcgataaagacagccattcccttggccttgatgagtaaaggagcgaaggcttgggcaagggagattggagcaaaaaaattaatctcaaagagatttctgacagtatcgagatcttcatcaagaattggcataaagtgattacgcccagcattgctgatcaaatagtccagagtgccattggttttctccgagatggtgtcaacagcatccttgatatctgctgatttaaccacatcgagcgtgagaagtgttatattagggagatctttgagcgtgctcattttggtgggatcacgagcagaagcgaagacgtgaaatcctcgcttttggaagacaatggccagtgcagagccgataccgccatcgctgcagccagtgattaagatggtttgcttggacatgatgtagagatgagcgtttgaagatgttgatgttctctgggagtgttcgtcagtggcataagcaaaaaataacgagcttatgtgtccttttgtattacccaattcaacaaaacagccccctgatgacaaatcatgccaacattttcccccatcgtcttaactgccacgtagtatgtgcgcatacgttgttggctgttggtgttggctcatacaaacatgattgggggctggcggggactggaaatcgatccgagtaaaacgaatggaatgagaccttctggggcgcattatctgcataaaactctgcctccagcttgcagataacagtccacactttgtgaccttttgggtcttggcaaccactcgcattcttggaacacttcccgttgctgcatgtgaatttccgatggtggaaatctctgaacttcagcaacgacgttaagttctaaaatgggaagatataaaaaaaaaaacagaagaacaaacagtggcggtgccagctacaaaggcttagcttatctttggtctttaagtatacatagctctatgaaaaaggatgcctatcttgaaaggaatagtgaatattaatctatcataggtaaaagcttagggtttaaatattgaagaactaatagaggtatagctaagttccctttaccttttaatctagttatataatgttatatatcggttgatcttaggatacctcttacttattgcgttaaaagatcgatcataaaagagcggactctgcaaccagggctataagcggatgagggaaagaaggatctatatgtatgttttgataattatgtatagaaaaataatacttcggatctttttctttccggaggatcatcccgtctcgcgctttcatgatcaagctcggacaatttatcctatccccaaagccagcgggaaaacaaccataatccatgagtaccaaccgtggagaaaacgtctatctatatccaacttaggcaatccaatagccaaaagaagccttatatcttgagccgttacgattagactgaaatcgcttcatgcctcctacctcttcgccaaacagcacataataccggcttttcccaagaaccacaagaacccgataaaacggacaatagaaagcaaggctgtcgcgtacagtagagttctgaaatacatgggagttcgtcccgtggaagctttctaaacacttgttagcaaattcattcgacttcatctttagtactccaaaaggaacaaacttacagcgacccccaaactggcaaattcatcgctggtaacgcccacgatcaatgccatgttggtgagaatccaagtgacaaccaggccagttcggaatgacttgtacgagtcgtccacgtcgattttctcaatttcttcctcctctttgaagggtgacagggccctcttcaccgtgttttggaactctgtgtcgatgtccacctgttctttttcgatctcctccaccgcaggcccgtttgcaccatctgtaacgacatgggcggaaggaagcgcctcaaccgtgtctgacccttttgttccccatgagacatcgtgccagttgttgaatgcaaacgtcatcaagatgttgatataagtcgacatgaggatgagatattgaggaaaggaatggaacatgtgccaaggatcgagataaagaaacgaggcgacaaagtttaggccgtaaattgttatcagggcgatcaggatgactccggccgcgccctccccgccaaagaagctgttgagcacatcctgccccgatgcaaacgagatctgcttttcgatgggcacactgagagctctgtataccagatacatggacaagatgaggatgtaaagctgcgagatcccgaacacgatgaaagatgccgtgtaagtatgccgtgaaccttttggcctgtttccaagggccaagacgaattgaatgatgatgaagatgatgtatatgtatttcatcagggtattaaagacgggcgttactctgtcaccgaatggccagccatggtaagccagaagaatctcaggtgtccccacgagatccatgataatggccgttgtgagatagtaagaggcgagagcaaaccaactaaacagaacgttcagaaagttgtagataagttgaatatgcagaaatatcattcggatgaagctgtggcttgacttgtaaatcctgccaaagtgcatcaaagagtacagcgaagcagcaaacgatccattgagccaccgtcgtcgctgattaaggaactcgacggttccttcggggacgtcggtttctcccttggcggccttgacatatgagagatgccagctttggcccgacttggccacaagttcgaaacaaaggatacgatcctctgctagaaacatgtttttcttgaagatgttcatgccatcaattcctttcttccccaatatcttcgacagcgtatggtctccatgaaagtattgttccaagggccgccccatgatggcacggaagcggtacgctgaaaaggctccaggtagaactgtaacatacccgaaagcactctcaagcggcttgtccaggacattcgatattttatattcaaaattctgaacggccacgaggggatttaacagcttcctcttacctttaccaagcatcgcgtggatctcaccacaggcgcctccgagctgcttgtcgttgtaaaatgcctcccagagcccaaggagtgaccgcggactaggcttcgtgcccgcgtcaatcaggatcgccacctctgggttcaggatccgcccgaatgcattgaaaagccaacgatgggagttgatcttcttgctgttgtcctgcttcagacagaacattagctgcacagggggcaggtttttctggctgtcgtcagcattgggacggataagctgttggtttggcgtgatcgagagttgggttgtatactcgaagatgtgcgctacagtcttgttgccgttcacgtcctgtttcaaagcagcttcctggtatactccaacggttgcaagcacatccaagacctccttgtcggctttggagataccatcaaagaccaggcacacaacgatcttttgccaggcagggcctccagcgccccaaaatgttgacttcttcagtctgacaatgtcgcggatgtttagcatgactccgtgaagcgtccgagccagaagggccttgtcttcattgtagtacgtgattgcaatcagcaattctgtgtgccgattgagcatccgaggccgcaagtcatatcccttctgtattgtgaagtcgttcggatcgcaagtagcagcagtatatcgcatcttgaggaattcgtcttccccactgtctcgatactgtggttccagagcattcttgattgcgctcggaacaggataatcggcgctgagcacagagcccttgacgagcttgaccattcgtgtattgcgtcgacgaagacttgtgcccccagggatctcggccctctgcaatacaggcagctcccggccatctccgggggcttcggaaacaggcgatatcggcggttggtacatgaacccattgttcagcatctggtcgaagtcgccaggcacgtcgccaggcgcggcgcttggatacacgctgctaggcgctcggtcgtcgccgtactctggcgggtacgtgtgggcttgacgatctcccccgtatggactatatggattttgatttgggtaaagcatcgaatcccgtccatcattggattccgggggagcatgatactgggggttgagtgtcagattctgatgcatggtcggtaggggggggatcacggatgagactcacactgacgctcataccaccgcgcatatcatccatttgatattcacgttcggcgtacgattcatattcatttctagacatgtcggctaaccgttccaattggatgggccggtgatgcactcgcaaagtggacgtggaaggatgtagaacgagcgtgggtagcaaggggtgaggtgcaagattggaatcgaaataaaagaataagaagaacaagaaggaaagaaagaaaagatacagaccctgaaaagatttcagaaatcaaatacgattaattatttaggacagcaaagctaggacagcaaagcatgagcattggaggcttgtcggcttccgcggagccgccgctctgacacaactgggatgatcacttagaagaaacgccggcgctggcaaaaatcggtcacggatcaaactcaattgttcttgtccctattaaactccattcatccatatccccaattgactgcaaatcgtgagtcttttcagccggctgggcggtttatgtatttgagccggtatcacatcgagcacctcaccccaggctacattgacgtcgtgaatctaaaagacaaaaaggtacttttttcaatggggcactgggcgtaatcacgcatgaaatggtacgcccagatttcctccgcgggtaccgtgcaacgcgcgcagtctgaggcgtcagatagcgctggacatcttgacatgctcacactgatattttcccgtcaatgcatgtttttgaatgcaattgttcaatcaaaacgtagactggctgaagatgttcatttttttggttcaagaccggtccttgcctatgaatctgtaaatcccggttaagacttaacttatagcaaacttacttggcccttgtctccatgatgccagccttgacttgttcaccaattaccccgaggaacgtaagctacaggatcggcaagcctgatccataagtagggagtgaccatggcaaaaagaaggggcgtcgaaaaaaaatactcgtatgtgagagctgttgtataccaggtaggtagcagaagcaaacgcctttagaagtgcgagatcatgaacattttggttccagtgagcagttgggacgcaatgagtggtcatgcattgactcttatataggaacaaccactaatttttgggagggtccgccaagtcgtccctccatttccgtttgacccgacgcaataggtcttggttcgtgaggatatcggcagcaactcctgcgagggccttgcccaccctcgccgcccgatgaaaagcatcttttgtccccgcggcctccgcaaactcaggattatgtggccccatcccattcggccctggtataatggaaaaaacagggctcaggctcggcatagcgtagctgatgtctccctggtcagtgcttgccttcgtggttccacgaatctcatcctgatcctgatctaccagaattctatcaggagggtccagggcgttgaaatattttgtgtaagactgggccaggatgcggttcggaatatgttctttatagcctctccgaggggtgacaaccaactttgcgcctgtcgcctgagcgccagcattgaagcaagcgtcgaccttgctcttgagctcttccaaacgggcagaattcttggctcgaacagtaaaagtcccggcggcatacgcatggatgatattcgaagctctgcctccatttgagatatagccttggatgatatcatcgggcatcgtttgctgtcgcagcatggagatgttgttatacgcagaaatgagggcatcgagagcgtttatccccagccaaggatttgcagccgcgtgggcttcccgaccaaagtactcagccttgaatccatgcgtggccgtggttctcatcagggcagcatttgcactcgcgtctggatgcgagatcaaactgatatcgacccgatggtcagaataagccccggcctccaagagattgattttgccgccgccacctggaatcgtcaattaagaatctttgccaagatcgcaaataaaccactgaccttcttccgccggtgtcccaaaagcgaccactttcccggtaggaatcaggttctgcttcatcaattctgaaacagcaaccgccccgaggaccgaagctgtagcaatgaggttgtggccgcaagcatggcctatcccaggaagagcatcttgccagggcagatctggtcagcgcaggtagattccgatggaggcaatcaatatggtgtgtctcacccatttccacattgaaagaaacgaccgggccaggacggccggtatcgtagtaagccacccaggcagtctccatgccgtaggctgaagacgtcacactccagccagggcgggatcgcatgtactccgtcagagcatcgtgggcgatgtgctctcggaacttcagctctgggtgatcgtgtatcctcttatttacgggccagaactgctctgtcaagccgtcgacaatttcgctgatgggctgaagaagagggggtgctggggcgtcatcatgcgacgcgaggccatctgcgtctctccacgagaccaacacgtagtcgtcgtcgactatctggaccattctgtgcggtaacggctctgacaatgtcttgcgacaagaagtgttggcaatacagcacagcacatacgtcaaccggctggcaggacgtccatggagcaaagcggctgcaaagtcgcgtgtgagatctcgcccatttcggtacaatcgtatgaaggagggtggaggcttcttgtgggccctacttcaatcatcacgcgagaatctttctctgatctgatcagcgattcattcggacaaggtcaccgaatatgcgctgataggcgaatgaagagcaggagagtgaatcaagtcgcccttgagttctgccattcaactagagctgacacctcgaacgggggccattgaattccaaacgatcaggaagcaacggcaagttccgcgaatacgtgccattattatgactcgacaaacagggaaacagtacccatcgcgcattcaggggctcggctttccccaggctaccctatacatcgcatgcagattgcagtctgctcatcatcacgccatgtgttactacgcaagcaatgttatacgaaaatttggtcattctatttaaatcgcatagactgaagtcaatcttacgtgtcgtattcttttctttattgtgttgtgatgttactactttcttggctaagggtttgatgaacggctaccacctactctggatttaacccaagatgtcaaaccgcgttggataaaggtatctgataaaagaccaatgtgacacacggcccagatgacacaccggtttccaatgctgcacatgtgtcgcatggccacttccatctatactggacttgactggccggttcaggatgcaatagaagcccgagagcaaccaagtctcattcaacacgctattaaaagttggttccccaccatgaactacggatctcagttgtaaagccgttgcgtgctttcaaccagtctcacccctgactacctatgctgctctaaggcacgtgtagaacaaagaaagccactaaggcagaatcctcgtggggggtaacactggtgttccgttctagagcgtataagatgagcatctcagcccccacttggagcagtgatggtctagattcatttcccgcgtaagcgtcgactcagcctgttcgatgggcctgagtgccattgggactttcttccagcagagtcttggttcgcattgagaacgactcactcactgaaatggactttgcggaaaactttaggatatttgtgtcaccaagagtgagtttggtacgcacggaagagcatcactcgctgggagatattcccccctgaatatgactaattgtcggttcctcctagcccaagtctagtccagcgagctggttcactaacgaggccgtcgaagatctagtcctaggtcccgagacggcgtggcggcgatggcacgtttgcaccattttcgttcgcgttgcgacatgatcatcaagagtctcgacgaaaggggagctcctcttccccagacttatgcatgagctttcagtgtggtattctctctcgcttgtcagctgatattataacttcctatgtggacaagatctaccattatgggcctgggtcaaccccccggcgtatagcttgcgacggctcgcggctcacggcatctagccctccatcaaagctgaggccggctttcaacttgatgcttgcctcacgcctagacctcccccacatccttgtccagtggcggttcctggccttccccacgtgttcaatgcatagctcgcagggccagcccatcaggttgccgtgatttccactccccgtcgagtatgagacgatcatctcagaattctccgcccgaattttgtgggtttacgaattgttaaataccgtctgtcccgtccctctgccatgccgcgatctcctgtcaatcgactatatttgttgttccattgcgttcggtggcagagatgtttcctaggatccagccactcagcctcctcgcggctttgatcgccgtgggtgacctggccgccgccgttcccgtcgattcactagcttctctcgatgtcagagacatgccccggcctcgcttcgggaatgttccgtatggtgtcgacatcactacctgcaccgtcaagggcaaggttgcgctctctttcgatgatgggcctggcgagtataccgcgaaagtcctcgataccctcgaaaagaatggcaacatcaaggcgacattctttcttgtcggctccagcccgaacggcaaaaccggcatctctaacgctgcgtacgcgtccgtgttgaagcgcatgttcaatgccggccaccagctcggcagtcattcatggagtcatcagaactttgacgcgatctcccagcagcagatgagagaagaactgttgaagaacgaggacatattctccaagactttcggtgtcatccctacgtactggaggcctccatatacccactgcagtgcgccttgtatttctgttctgaatgaatatgcctatcacattgtaagatgagtgcccttttctgaaaatttcctcattcctaacaatgaagtagacggactttaatatagacacgagggactggcaagatggtggtgtcaacgcaaaacagatctactctggtatcatcaaagccagtaatcccaccaccgacaagtggatttctctggcccacgacatccaccctttcacggccgatggatttgtccagtacatgatagacgtcgcgaaggagaaaggataccagtttaccaccatcggcgattgccttggcgacccctcatcgaactggtaccgtgatcccaagactggtgggccttggagcggactcaacgataattccaagcccagcacgactgtcaagtccgaatcgtccaccaagttggaatcttccaccaaggtcgaggcgacctccaagtcacaagctccaaccacaacctcttcatcaacaacatcctccagcaccctcttacagactacaaagactagcgtcgcggtgagttcttctgtagacagtcgtggtactcagaccgcttccactatgagtgccaccacgagcaccaccactacaagacctccggtaacatctgccgctgctgaaagcgccaacatgagcttggaaccagttcactcgacgacaacgacttcggcctctactgtctcttcgacttctgctaagcctaattttgctgacagaaccgtattttctgtgtctggtgtcttcgcaggtctcatagcttggtctgcaatgatgctagtatgagcacataccagcatgtgagcttatagacgatggatcagttttgatatttatgaaacgattaatagagagatgagttaatgattctggctttacttagtactcggagtggaatagaatagatacactacaaagagcataaagagaataacgaatacgcgtatagaatactttgaaaacgatcccctgtatcatggaatgctcagcctcctgtttggtgaccttcctgaaaaggtttggctgtgctactactttcaaacgaaattgcgattctggagaattaagagtcactagacggcagtagcgtctcctttgtactcgtattcatgttagcctaatagcccagcagccaacacgcaatacactttgccactaacctatatacaaatccagccttaattacagagtagagatccttttattatacgcgggacatggggtagatggttcatcaattcaggccatggaagccatttagtagcaatcactggcctgacattcataacactaacaagtctgcggctccaatgatgaaagtaacaacagtattgctcttgatttgtttttatatttatcttgtccgtgtgccagcgtgtgaacccttcaaacatctattctgcaatagtaattcatccgataaaatatgaacctactatctcctcgggcatcttggctgcctaagaaatgttctgttcttgaccgctgatatgtatcgaatttccgtgacacactgatcacgtgtttttagatgtcgcgagcccatgatcttatttatgactttgcaagtagcagtggtggttgattggttcaccagcagatattcgcggatgtaaagtgagggcaggcatgagaacccttttgattccaaaactgcaaattcagcagatgaggcaccgctacctattgcaagtcacattgtaagtcgaagtgctgtagcagaagaatctggatccgcgctttatccacctcgtcactcgctattttgagagagggtgcaatctgcactgagggcttggccgtaaccttttctctattcaatgatagatttgacctcgtctggaatggaaactcaagggattgtatgttctaaacatcggcgatctaacaattgttcaaattcacagcaggtgggtagagttggcttatcctaataagctaactgtttgagatgaggtttgtaagaatccctgcttctgtgtagccacgattcttcttgaatgcacgtctttcccaagtcaagttagctctttgatccatgaaaaagaaatatcaatcaggtgctgctcacaattcgctctgggatgtcattgacaagcttgattcaaagaaccaaggcaatacagatccgataccggccaaatccgggaaattgatgcgtctgtcacgccacgcttcagcgggtattgaagtcaataaaaggtgataaaacccggtttggcggacccaaaggcggatgtggtatcgaaacaggcatgtcaagcttctacaggacctaaaccactcactgccgggatactacaaatgcgtgtaagcttctttaactcgcaggcggtcaagattggttggttcttgtgactaacgcaaggggccgatgtaaccaaaccggattcaggctgtaatcatttcgggaagctctttgggtggtcatggctatcaaatcgatattacgactggggccacttcaccttgccccgtttcctgtcaacggtcaaattaggtggtgaagtggcttgtaaatatctcattgcctctgcctactggccccatcactccggccaacccggtaagactcgctcgccactattgaggatgttcttggctctccgatcggaagccgattcgatgaattccatcttatctcctgccggcccatcttatctgattagatcctcctcatcaagaccacaattctcgatgtgacatgggctatgggcagcagggcgggtaatgcaatgtcaccctcatttacgggataaagggtaaacgtacgggataaatgtagaggatcccgctgagcatctggcttctcttcgtgcacatttgtcaatcttcagcccatagctactcctgcaataggagacttgagtaacgatgcatggtccattatatttggtcttgctcctcccattgctaggatcttctctgggagaatcgatcgtggatggctctctgggttctgcggcatatcctgaccaaccattgagatacattgtccagttctcttctcagggagctgcccgattcaggaaacgagatggaagtgctgtatgttattcattttctggatgttttgtcatgtggctgacaaagtgatgtggcttcttgtacaggacacttccgaattcttctcgactctcagtgactccggacaaaatgttacccccgcgttgaacttttcgtcgaccttgttcgagggggcttcctttgacttggctcatcccagtgaagagtctgtcgaagaaattcagtccctgccagaggttgaaaagatatggccagctgccctcttttccattcctgttgtcggcaaagcatcgtccgtagacaacgaggcccttgccagctattctgtttggaacgcacacaacgaaacaaatgtcgcggccatgcacaaaaagggccatcttggcaagggtatcatcatcgctactgttgacagcggcattgactatacacacccggctttaggtggaggttttgggcctggcttccgtgtcgaatctggctatgacttggtgggtgatgactacgttgtcggtggcccttatgcccctgacagtgatcccatggattgtttgggtcacggaacgcacgtcgccggtattgcggcaagcagtgatgccctgatacctggagttgctcctgaggcacgccttcgctcttataaagtgtttggctgtggcgatggcgtttatgaggatgtcatcattgctgcattcatccaagcccacgaagagggagctgacgttattaatgcatctctgggctccaatcggggatttacagaacaacccattgctatcgtcgtgagcaaaatcgccgcagaaggcgtctttgtgtctgtcgctgcgggaaatagcggagatcatggtgagttacaaacttcactccccttctatcagttgtaggttcgctaaccacgatacttaggttccttctacactagcagcggaggcaacggtttggaaagttttgctgtaggcagcgcagaggctcaaaactgggtcacatacaacatcacagccacttcaacaagcaatgagacaagatctatggtaagtgatgggcatattccttgcctctacagcgaccttcgataagtctgacataaatacagtcgtacatcagcgataattataatcatgtcacccttgatggaagcgtccaggcttatgcctatccaaatgcaagggacgtcgatgcctgtaactggtcgctagcctcaacccctaaagatactgccttattcattaggtatgataatgttcttgaatctttgaccagtggatgtgattgtctaatcaaagtgagcagaaagggagactgcgtttggcaaatccaagacagtaccttggtaggcttaacatccagtgttttctacattcagaaagaaggagtaggtctggagcgtccaggccgcgtccggggcagcgataatgcccccgaaaactgtacgtcgtcccctcctccccatcccctaaaagctctaaattaatgacctgatagcggcacttgtactgtacgaggacggagactggattctgaaacaattcgaggctggccacaacgtgactcttcacttgtctacaagttctgaccctgtggccgttcccaagtcaggatatgtcggaggtagaatcaacgactacagctcctggggacctaccctcgacggcagaatgaagccggaagtctctgcccccggcggtaccattttatcgacttaccccgtcagtaagggtagctgggccgttctctcaggaaccagcatggctgctccatacatggcaggtgtcggtgcactcttcttctcctctcgaggcggccgcgaagccctgggaggagacagcgtcaaagtagcccgggatcgtgttattgccagtgccaggtcgattaagcacaatgatggctccggcaacgaagcatccgttggcaagcagggtgctgggttaatcgacgtccagaagattattgagtctgggaccacgatcagtcccgcttacctggagctcaacgataccgtgcatttctcgggaagccacgaagtcgttctcacgaattcgaatgatgacagcgtcacttataaactaacacatcaacctggcatcactactttcacattcacttcatctaacgcttgggttgctttggagcccaagtattcaaccgcagaagacgacgtggccaaggtatccatgtccgctgaagaggttgtcttggatgctaaagcttcagtcacggtcaagttcgatttcaccgagccagctgcccctgacagctctttactccctgtttatggaggcaaggttttgatcagcggatcaaatggcgaagttgttctgctaacatacctgggtaagtttttccatcactggtcgtttttccaatacatcattccatgtccttctaacaagtactatttcttaaaaggcatcaaaggcagtatatatgatgctcagagttgggaaatggacaggggagtcccactgctcctgagcggatacggaggcgtgatggaagaaggtcatgtctacacgtacgaagatgggtcagatgttccgcaaccatatttcaacattctgtggagtacgagagagatgagttttgatgtaagtccatgtttctttggccatttccattcattgaaccacagctgatgatgccggctgcaatagtttgtcagacgagactggcagcccagcgattggacatatccaactgtcgctggaaagaacaactgggtcgggtcaatccgtatgcgccctaatgggctatcaggagaggtggtcgatttccctcttcaaaactatcctagacaacccggtggcgctttctatggcgcttcacaaggctatttcgccaatggctcgtacattactgatggcgagtatagatatctctgcagaaccttacggacattcggtgattacaacaacatcacggactggcagtacaaactttcaccctggtttagcatctcaagagacccctcagtgtcctccacgtctacaactatcaccccttccgcgacaacttcctctgcaattaccacgtcaacgagcgctgcgcctgtttgcacgccggggtacgccagacctgtttcaattaagggatcctctggtcaggcatcagctgaacatgagctctatctctactctgatttcttggcagttgatctttctgacagccagcccactcacctcgattggaagatcaacagtgagggccggttcgagacttcaatcaatggaaacaccgtctatctggctgtacacaccaacagcaacagtcttgtctacatgtatcctgcgtccaaaatcaccggttcatggtcatatctcgaatgcaccacgtcaggcaacgtcctgagctgcaagtcgggtgaaaaggacaagttttatacctgcggttcagatcttctcagacacgggtcgactgttttggacggatgtgaggctctcacgctaaagactggaccggcggctgatccttgctctgtgaccaccacggattcgcagccaacgccaacgccaacacctacaatcaccaatgccccggcatcttctactacggcgacccgccgcccttgtatcccgagaagcaagaaatgagtagagatattcttctcttcgttctgcctagggatttgtaattagttcagagtcaccagacggtcatttcactttgttaagacgttttggcttatccaagcctcgaaaattgatatatttaatagtacacgtgctggatagaggtttaattctatttcttgtacctcgaaagtgcccctcagcaagtgatgtgatgagaagtgtcttattagtcattgcagctaacgacttaaacagcgagctcacagatagttttgacaatcagaaacaggggagatggtttattgtttgttgatgctattactatctctggccatggactcaccgactcacaggccaaggacaacactgtcaacaaaacatatagttacaaaagtaaatcacggagttgagccttcaagtctcctcattcctgaggatggccatcttcgctgttgtcttccaccttgctgggccgatcgctgcaatatctctgggcactatgctcctcactcagtctgcgagcaacatcatttgcctcattaagcgacacaagccgacgaggatgagggtgatttctgatggcagtgctgcagaggtcccagattatcctctcggtaagatcactgccaatgtcgaggtctttatcattttccttcagacccgcggctgtcaaaatcttctccaccatctctggcttgtattcgccactgagaccagcctcactaagcctggctgccgcatttgtgctggacagatcatcggtacggccattctgagaggtttccatgagtcgtatgatgtgggtaatcgaggtacccgtataacccagacccaaggtatttggcttgaccagctgagatgccgttagattgtcgtatgctatctcagcgggtgtgcgaccgacggcgttctcacggtagagaagttcaggcttgaactgaatgagaaccctagcgagaacaatatgacggtacattatagctgtatggagaggagtgtccccagcgccattgagaagctccagtccttcaccgttggagtattcgagcaggaggttaagaatctgggcaacgtctttccactctccgtggtagtcgtgccatcggcgttgtgaataatcatatgtgctattcccgccttggccacagaccatggagatccaggaatgaatgggcgcagtaccaccatgtgtcaatctcctccgttgttggaagagatttgcccgcaaggttggatcaatgaggtccaaaacctggcggagggcgtcgacatcctgcttcctgcccagagcaacgtgcaagatattgtgtccagtgtcgagacgtacagattggtccacgtttgcctcgataagaatcttcatgatttcgacatttcgattccaacaagcagacatcaatggggtgtaaccgtttgaagatctcttctccagaacatcgggacaaacatcaatcagaaacttgactagcttctctgacttctctgaatccgaacactctatagcatcgtgcatgacggagtcacctatttcgcgtagatggtcagcatttatcatagtaacgtttttcgagcattgggggggttggtgtacggtcacttttaagccacttcgacacagcacggttgtagccgtcaggaaccttgttcaaaagccgaatatacggatctctggtcgcaatacttgaggatccaaaatccgaatagaattggtacggcttgtcactgaggaagtacctgacactttcaatcgaaccggaccgggcagcataccgcaatgggctgttactcaacccgtttcttgtttcagccaccgtttctcggccagcgttggcccaatctgatctgaatgaagttagtatgttcgacgtgtttggaaggatcatgcaagaagctctttggattaccttttcttcccgtagaccgtcagtccttggtagtatttgggcttcttcttctccgccaaatcgagttccttgacgagagtctccagcggcacaccagctccagtttgtgcaatgacgagcccgagtaactcggtctttccattcctgattccgtactgcagagcagcttcggggaaccggaatacgccgtgctgttctccctcttcctcctctatgttcttctcagcatcgttatcttcctcgagagcttcttgcatctcatcaccatcttcttctggttctttcatctcttcatcctccttatcgccagcaccggcttttgcagaatcatatttctgagatacccaatactgagcttgctcaatcagaaactgcattccgtggcgatcatcgtgcttgaagcagtgctggaaaagagtaccccgcttgaatccttcagcctggccatccttcatgatgaaacgaggcgcctcataattgatcatcatgtgcggtttggtcgtggaggtgacaaccatcgatacaaccccgatgtcgtcgattgtcgattttccatcggccttctcgccgacaatttgaagctcgttttcctcctcgctcatctcatcgtcctcgttgtcctcggcatcttccctcatcttatattgcatctttggtttttcctgcggagcccactgcgattttacgatctctagaacaactttggccgcctcatagtgtcctcggaggaacgcaagagaaaatgcattattcgactggctatcgtttacggacatcttgagcggtggttggtcttcgttggggcccgaggggtggagggccagggctctcatacgttcgacatcaccggcccacgcggcctccatcctaaaagatcgtgtcagtacatggatgagatgagaataggaggtaacgcggggaaagcatagtggagggaggtgaaaatgaagagagagaaaaaaagccatatcatgaactcacaaattgaggtagcctgccttcctcgcgtccgtaatgtcctggtcgccataaaagcaaaattcccaatcgaaatccttctcctcttcttctgatgggctataccggtttggtctgtaccctcggaccctttctgggcctttcacaccagggtgaagctcggcaaagggcttagctcccttggatttcagtaagtccctaaggttctcatatgccaatttgatatctcttaaggcatcctccttggtgtcattcttttcagaaccggcctgggctatgttcttctcgtattcttccattttcttgagaaattgctttttgcgtgtcttgatttgctccgacacaacccaatgctggtaagttcctggggtgtacttgctaagacacgcgtccgtgttcttagggcccttgggtggttcggcagactttttgaagaagttttttgtttgtaattttttatttatctgatcaagaagattgtccacgacatccagtgcactgttgcccgtggaatggggtcgcctatgctcgtgaataagaagaccctcggtttcggcggtcagagtgtttggattcgcccctgattctaacagttgcatcgcaatagttggatggccattgtatattgcgcagagcagtggttgatggacttttgatcggaaggaatttttgctcccccccagatcgccgagagagtccgccattgcgggtgaaaacttggcagacttaagccacgtttcaaacttgatggtgggctgagctcccatgttcaaaagcttgagagtaagaattgagtcgccttgttcaatggcagtgtgcaaagccgaaatagtaaccgagctccagctagaaccagtaatgaccaagtggtttatagcccgcttgacgcctgagcggtcggattctagcagtgtgtctaccatatccctctgaccgctcgccacatatcgatgaaaggccgtcgttccgttgctctccgcctgggaagaagtggctcccaaggtacagagcagctgagccatagatttggccttcgctgaaggaagcgtcaatgccaatgtcaaggtcaggagcgcggtgctctgctcattattgtagcgatcgaagaatttcactggcagaatagaatctgcgctgtagtcgcagagcatcttaacagcatcctcgtgtccagcaacgatggccagatgcaacggagagcaaggaacatcccacgccagcacatcgatgttaaaaatgtccgggtcttccgcagacccgtccaagtctttgtgttcatcctcgtcatttcggatcttgacgaaagatgcagtcgccatagactcatcatcatcgctgtccggctcatcaaccagttcgatatcagactcgtcagcgtccttggctatgggcgtgccgttcttcctagttgtggctttcttatccttcctctcttcttccgcttgttcattttggagactcctctccatgaggattttgataatttccgaactgccgcgagaagccgccagatggagtgcggtcctaccatcggcgagccgagaaatcatgcgggcgccgctgtccaccaggcactgtacaatctctggcgtggatgaaacgatagctagctgaagtggtgtgcggcctgtgtggtccctctggttaacgtccactccatcttgagacaaccaggccttgacctcatcgagatcgccatcaacgatcgattgacagaggcgggccgtgtttccgacataggccatatcagtccagtcctgttctgttaatggattgaatgatccaatttcctgtcttccgggatcatcaactataaaatccatcttgccagagacatatcgtttcgattccttctccgcaacctcgatctcctcatcagtggttggtctggggcatgaaccgcaacaatcctctaccacatccttcactcgaccgaagaaggcggggtgccgatggaggtggaccttgcggtggtcgtctttcttctgattccactcggcgttgagcagcaggtcgcgagtgtagcaaagcttctcgatgcgtttagcagtataccttttccgtaaggtaccgtgaaggtggtatagctgctggcttcttcctcgtactcccactctgcgacctcgtcttcatgatcgtccttgatgtttcctcccatttggaagatgtatccgcggttgatggctggtcttcctcgctccttgcgccttttgtccaaatactcatccctcgatgaccttgtgggcaaccgctcgagtaccagaaggcgagcaagaccaagggttctcctaaaattcctctcaaagattgtcgggtcaacacgcgaacggtccagatcaggccagtaaatttcgaaattgcggtgtgagtacttggacaaacggttttcataggaaggactgcgtcgtgtgagatcaatatggttgacctgcgtaatgaagctagcaagagctcgaggagtcacatagacttgtcttccgccatacgcacccccggcggcgtcgatgtcaaagccagtcagaatctcactgagactcttgtagactcgcaaaacaatctgtcaataaacacttagttattacatccgaaccgacagcagccgcctgagatcgagctatatgtagacaagggggttacaaacctgtatgtggcggactggatattggctggcgatggttatcgcatatttcgtccgtacgacggtgacttcgttcaagagagcatccttgatagcgcgttcaatttgcttgattttctcaatagcctagtcatgggtcataccgtaaaggaacaagtcgacatctgaggccgggcagaacttctcatggtaatactctctcagggttcgctttgtctgcttgaaaggttcaggcacaggcagaaggcagttgacgacagacgaccctgctgcgaccacgttgtcccagttcatgtccgaaagcgagagttctgagaagatgttgaagttcttttggaattccgccatgtcggacactatagcaggggacccgtgcggccggcgtttctcgtctggaagcggcatgatgtactttgccttctcctcttccgattcagaggccatgtctctggcccgagttgcgactggcacgccatttccatcggcaaagagcggcagcgcattgaggtaggggtctttgagaagaggatcttcagggctctgggcataaagagtccgcaattgagcctcatagcggcgatagggatcaatgatgtcgccaatgtgctgttccggatgctgagcgatgtattttggcagctcggagagaggcgcaggcagtggatggagacttcgagacgccattgtaacccgcctcgcgtgggagaaattccaacggtaagcgattgacttctggaactgtgacacgcgggaccgcaagaagcagaatgaagccatccgagacagagagaaagaggccagacggccgcttcttatgtgttgcgcgacgagtcagcagaggaaggcacgatggaagcgcacaacgtgacactgagagttggagcacccgtccacagtgggccaatagcgcgcgggtaggctgattccaggcagccgcagctccagcagccactaatcaagcgatgctacagcggacagacgccacagcccagcggtttcaggtgccggggtccgctataataagtggctctcagtggatgcagataagctgacagggctgagaagatcttttggttgcaccagcagggatcttctgcctaacttcatgccaccatttagccaaagttctcatgatgagcgacctgtgaaattcttcacgccgacaacaccatccattaccgagacgtgccacaccagcttcaggcagcaccgtcgtaatgagatgaggcatggaacatgggtggcaacactattcccgtcgcatacattctatcctcgccgatagatattgatgaacaaaatgacgtgtggcagagccctagaaacgcatgttcacataggttagtcactccagagtgcttgtgtcaagcagctcataatttccgagatgtatgtgttgtcaggcattggcggcaaaaaagaatatattctagctagtttgaaactcaggaaactcatgtgtgcaataataataccatctacccagtgagaatttggctggttatcagaaattccaagtatagggtaaacactccttcgcatgcttcagatcgcagctcgagaaagaaacagattaaagaggttaattcatgaaattgatcgaacaagaaatctcttcaccactctagtccgcttcatatcagacacatggcccatgttatagaaacaccaaggtccgaccgcccagcaaacactgtacaccctccccgtcacattttagtatacaggtatcttgaaagccgggaagctgtaggtccagctatcaatggactcccgatcatcaacgcactggaactcgtcgctgttgtcctgccagaggggacgcttgggccactggcaaagcatctgagtctcacccgcattggtgccggacgacacggtggcattcagtcgactgggcttgttaccgttctccacccaatcaatcatgatgtccatgttgttctggggataaggcccgggctggaggctgttgcttccgcagtggccggcaccggggaccaggtagaactggtaccagtcctggagagcattgagagcatcctcgtcgttcagcttgggatacatgatggaccggacggactgccagtagtggaccgaagaagctgccgggatacttgagtcggattctccgtggtagtgtaggagcttgcctcctgaagactggaacagggtaaggtcagggagggtggtctgcagactgtccatatacctaatcatgcccgtgttcatccagtcgacgagagtgtcatatgtcacgttgtcaaggttgggcaggttatcgagatcgagcagctgcacgaacttggtaacatactcgcctccagtagacgggatactcaactcccaggcattagtctcggagttccaggtagtagaagcatcaccaagctcggaagctatctgccatgagaggtaggcccgttgcccctgtgagttgaataggccatcataaattgcttgagcaaccgcaactccctcagcagagacggctccgttctgagccggctggtaagaagttgagctccctggcgcctgccgcttgtataggccgtcgcttcgcttgttgaatccaaaaccaagcgaggttgagttcttctcggcgcacgagtaagactggccgatgatagacttcaagtcgaatttgagcttgcacaggtctgtgcgggacacgaccccatctgttcggccatcaagagcgtcgcagccagaaattgtagcattgacaatcttggcgagctcacacgggggaggatagtagtcgagtgtgtgctctacagccgaggagaggacatggagcacttgctgctgtgcgaagcggaaagcgggagcgccggcaatgacaccatcgtactcatcaccccagcgttgaacttgactcatgccttctcttccaccatcggagcatccctcgtagtaggtgtaaacctttgcatcagtgtcaaggccatacagattcttcgttactgccttgccaacttttgtcatctcacccaaggcttgatacccgaacatgtgagttgcatcccagttaatggaaccgtttccatacagaacgacctcatcatagctagtgctgaagctgtcgtatcctgcgtctgtggcacctccggcggcgccatacgaaagaccacccgtggcgtcgctggacagggagaagccacctccaccggcaacgtagaagcgattcttgaaggtggatggttctgggaatgcgtacttgagcacgactgtatcgctcctcccggtatgagcataagagacagtcacattgcagtagttgtaagtagttccgctaccgctgttgctaccgctgccaccagccccaccaccaccggtcgtagcattgtaaactgggctggctgtgacactagaggggaccatgtcgatgccgagaagatcgccgtctgctgggagagcgctctgaatctttgaaacggagcagatgtcggtgagagaagcgccatgagtagtggctgccatcaatgtggcaacgcccaatgttgctcggcgcatggttggaatagtctggatgaacttttttcttgtttgagaaaggatagtgatactgtcactgggaggagtaagtggttaatacccagtagtaacgacagacaatggttcttatatagaactaataagttgccgcattgctgtgacagaattggccttggaccctcacgagtacgtatgtcacatccatattgtcaaggccagttgattcatgacaccgctaagtgtccagatacggacaaaggcccgagttgtagtgccatgagcaggctgtcggctgtgtttgattacgttgcatggtgttcctatttgagcggaactcgtccaagttccgaagctgggttctagtatgtttttgacgcttcgatgcattctttccaagcgatactggaagggtggaaagacgcgcgttatggacctgacctgcccacaattatatgtcgcggatcgtgaggcggagtagccgggcgagaatagtccaataggaaacagatcccccggtagcccggcacttgtcaaagaaattccaggagaaacggtccaatgggaactcgattgcccgtcggcactgcccgtctcgcccctgcttttctgccctgtgtcggcatttgtgctacacgagcctcaagatgtcactacatggtttgcttcatgcccatagcatattacgtcacaggaaatataaaaaggcctgattgatcaagcgtagaagtcgatcctaatataagcgggaggaatgtggccctccggatcacacacttcgggtccatcaccatcaagccctggccttatcaatcaagcgactgacataaaacatggcacgccaaagttctgttcacgtatatcagggacctcatttcgtattgataatactgaacgtaatgataagaaaattaacaattattattctataatatatagcttgacattgtgttgatatttgtgttggaattcaacgctggaggttctgggtgccatgctttatatcagtcgcttgtcaatccctcggtatatatctttcgggcgctttcaagggtcttggaattaatctcaatcccctactgtgcctcactcaagaaaacgtttctccttgtcatgtcttattagctgtggctgatcaaaaccatttgattatatctacctttatgtctcaactactatgtaccctcatattattacaaaaagcgcggttcattgctttcctctcctcaagatgctgtctctgtctgaatctgacctgttttcgaagtgctcgttcggggtgcccacaactgtcggacttccaaacattgtaccactccccgccgtattattatccagctcgtaggtgagattccctgacatttcggtgggaagtggctgtgagccgaccatctcggcttcaggcaatggccgtgagcccatcatctcagcatcgggctcaggccttgagccatatgcttcatatacaggaggcatcacctttctgtcatcatattcccctccagcgctggatgctccaatttccacaggtgcgtcagaagctgccgccttacgtcgtcgggtgaaccaagccgctgccagaccaatgatggcggctccgatcacacctccaacaaccgatcctccaattgtcgcaggagatgccacagcggatccggattctgtttgctccatggtcgtggtgctctcggggatgacttctgtggttgatacagtgggtgtttcagcaggcttcgtcgcattgtccgggcactgggcggcaatctccttgtcctttaccatcacaagatcgtttttccaaatcgacgtgttttgattggattcccacaacgtataggttccaacatcgtgattaaccattaggtacgcgctcgtgaggaagtatcttcccagcatggggactccgttcggggtctctggcatggcgagttcccgagcacttgtatccatgatacgagatccatcttcatcatggtagacgtgaggtggcatatattgcgtgtttgggattcggattttcaggccggattcaagatgaaatgtcatatcgcctttgaaactagagagtgttagtcctacgtcaagagagagccaagacagttaacttacgattgcttcctgtcatatatccacgcgccccaatgaaatccagttgatgtattgccgttatgttttgtgcctgtcacctcctcaaacttgtcaagatactcacgagggggctccaacagagatggacgctggggggccaggcaagcatggagtttgtctttgttggggaagatgctcatgttggaaccgtcagtgaaattaactgtgatgtcggatatcacaattccaattccggtgaaacacccatccgatttagaatagtcgccatacttgaggggtgcagtgacatttggctcgatgattctatttttgtcgtaccctcccatcaccacatgaccctctatcggccttgaattccaattgctgccccaatatatagaaaatgcgcgcgagaaggtccacccggttttccgaagcttgttgaggaatgtagaattggagcccaagccaagaggatgtaaagtgctgtgccctgtgtcccaaccttcgcggggtataccgatcggtatttgctcactgaggctcgcgtctttgataccgaaggagttctccattccagcggtgttgttcttgaccagcttctcgatccctgactcggcaccctcaagcacgctctcgattgaacctccagcttcaatcatgttctttgcctctttgaagctttccgatttctcttgcgcgtagtagttgccgcgaaggactgtgcagccctgtgtggagttgatcatcgttccgtcgcagaacaagtccctgccataaatatacgtgttgttcaattcactaccaaaacaaattagcaaaatagcccgaagacctgttgcgagaaatatattgcctacagccatggcatgaggacaatctgagttgaagtatagctcaaatagccgatgtttcccggaatgccctccatccaggatccagcgacattgttgacgacttgattatcacgtattggtagtaaaaccggttttctcgtacaattgagggggaacgattgagcagcgacgccagaagcgatcacgaagaccaacagctgtgctaataggtggtgcattttgactatcgatcttcaagaggcgtcatcagagcaaaccagggtgggatatcgagatagaaggcgcgtagacgatctaggcacagcttcgccgtagagtacgaacaagcgatagtttacatagagtccatgagagcgggagctgaacctatgacacgaatagggtacatattacctaagtcaaatcattgaaacctcaatttgtttctgactgttcggcgtagtcctgccaaggaatgtcaaatcatcaattagggagtttatgcgaaggtaggatcactcctttactcggcatctccccaaggtctcaagtcagtatgccgaaaacaacaggtcgctatggaactgcatgttccttcccgagatcctaatttgattcgctattatacgccggatcaccgggatcgacccagtcacaataaacttctgagacgcgggattgacgcccactctcaaatacaaaaggaaacaaaccctgctcggggtatcgttctttgatgggattggcccagaagcgacatcatttgcctcccgtcttccctttcccacctcgtgcagggattcggctcgtctagactatgcaacaaatagccaatgttcccttcaacatggcaagggccggcggaggatttatgagtgaccacatgccctcccatgcttcttcgatgtcttgaccctcggtcccgtcaatctagataactcattacaaaccgaggttcctgaacggccacgtcgtatcggcccattttccatgacatcctgtgacatctctccattgcatagctggggggtgattttttctggtatacctacacaatcatctaaccagagtgaagcacccaaggaggtcgctccgggaaaatgggcttacagaaaacccatcactctagaccatagactctcagatatctagtgataaatattggattcaaacggatccggatacggttactaacgagtgcttatttggatcaataatgtatgtgtattcaattccttgttttgtgttttgctgttcttacgcaatgaccttagcaatagtgcaaaaaaacttccactctgtcaatttggtgcattttagttcttttctgattgtgtttcttcctcgtgtacgtaaatatccttaaacataggaccggggtagtgttttgtcgcatgtaccagccaccacaaggctgtaattacgagaacgcctgcgagaatcacgcaattgtagttcattgtcgtcacgtcaaaaggcaacgccaaagctgttaaaaaaaagtgtgagtatgctggggaagcgagatggcagaaaacagaaagcattaaacttacgaaagcaaaagaagacgtcgaacaacacaatgaatacgatagctagagaattaatcgcatatcccctcaggccagggaggctgaaaggccccttggtaaagtactttcgcccagtggcaagatttgcgaccattgggatagcgtatgaaactgtgctaaggatgatgaatgatcccgtaagattgctgaagccgacggagcttgcgatagggatagctcctattgccgtggtcacgactgcaacgaacagagtagactcaagggggcagctcaaagtctcgttcactctccggaatacgccagagagaggaacggcattatccctggccagggcccagtatgttcgcgagcaagagagcaggctgccaatgacggaacaaacaacagacaggaagatgatgaacaaaagcccgaaggtggctgccgggctccctgtggcctgtctgtagattccagctaggggaaagttgttcacaccagcgtcgagtgcagtaatatctgaaatggcgtatgctagagcgacagcatatgccaaaccataagcaccaccaatgccgatttgcaaaaagatggcttttggaagatctctctcaggattcttcatctcttcagccatatgagtaatgacatctgttgttccgatcgtaaaggcgccatttagaacaccaatcatgaaggcaacgcctccttcccaaccacttaagttgctctcgttgaaggaggtccaaacaaagtcattcgatgaatgctctgaaggcattgtggcaaggacgatgatggtggcaatgcctccaaagacaaccaagaacaatcccaggtgttgagagtatggtgcgagtcggttggcgaagagaaccaacagtgtgctgaagaggaggataacgaggtatgcaatgtaaacgtgccaggcttcgacggcgtatgcggggttatatatggcgtagagttgtactccagcgttggcggctatttggacaagcgaagcaagaccaaaaattgaaccgtaaaagttgagccatcctgtgaagaaaccggtgactcgcccccaactcggcccggcggcgatcgtagcccagtggtagacacctccggcagatgggaacgacgatgcgaactatgttcttccttttaggttccggttggatattttatcgcgtggatcgaacgtacctccgcaagactcatgccgatgaagctatagtagaacactgccacgatgagaccgaatatgacaccaggagggcccccgttcactaatcatgagatggtgttagtctttcaaaagaagttttactcatctagtgacacttacagagagaaacggagatggaagaacccaggacaacccaggcgttgttgatggtcaccgccatgccggcggcttcgagaagcccatactgtcgactgagttgatcattatggccggacgcattgattcggctctcaggaatagcaatagtgtcttcgccgggtataggccttttctcggtcctggccgaggacttttcgttggtgaatgtacccataatgggagtaagccagaaatgatgtttgggaatcaaatgaaactaattatccttgaggttcatgccacttctttgggtagtaacattgtagaagagagagagatggcacccaaatatatattgagttgtggtaaccctgcacaataggttctatagggagatgaagataacgggagatatgcttcatggctggctaagtatgggaacaaggtggccagccctgctcaacgcgcaccatgatgcatacaaaaaggcgccacttcgcggcttctcttatcaagcagtgcctggaacactcggaatgtcaccagagtcttatcacagccagtgttagggtgtgtggggggcacaagggggagtggaaccaacctcaaaccccggccgagcgggcgcaagataaggaagcaaagcgatcatctcgataattgcatgattgcttgaaacagttggcaagctagacgagcatgaagaggaactcccttgattatatcgaataattaaacctatcgaagattaaactacacgatatgtacatctttaagccgagctacgcttcaccatgaatagtgccatatccaccgccgcccattccgccggccaccagtctatccgatgccttcttcacttctatgtcccagttgctcagtcctacgatgatccattctagtataccaacaagaaacagagctacacactgtcccatccagagcccctgtagcccccatccatggaatgccaggtagataccaccaggtagagcgcaaccgtagtagctaagacaatttacgactgctccaatccattggcgacccatgcctctaagtgctcctccgcaactaccgttcaatccgtctgcaatctggaataatgcaacataaggcatgatcgcaaccacaagctcaatgactcgctcatcatcgttgaagagccttccgatttctctcttagatatcatcaacaccgtgagaatcactgtgccgaatatcaccgaaaggactgcggcgctgtgtgcagagcgtcttgctcctcgggtatcctcggcgcccaataggttaccaaggcgagaggatgctgctacccccagtccaaagggaatcgtgttgataatctggtccgccgtcataacaacagactgggcggcaagcgggattgtcccaagtcggccagcggcgagagcaacaatctcaaacgcccaccactccgttccgacatggatcactccgagaaaagctagtctagcaaatggccatagatgggccactgcctttcgtggggcgaatccatcccagcactctttgccttgaatgaaagccgagtaggccaccagtagaatgaaagaaagccagtaagagattcctgtagcaataggtgctccatccagcccaaggcccatctgataaatgaacaggtagttcaagaccgcattcaggggagacgtgatgagcaaaacgtatgtgcccgctcgatatgcgccctgcgcctggaggtatttcttcatacactcgaaccaaacgtatccaagacccccaggggctagaagctgcaaaaagcgagcactttgacgacaaatatactcgtcttggcccagagctcggaagatatgctccgaggtgaaccagatgatcatgacgactaagtagtaccccgtgaggacaataatacctcgctggagaaggatcccgaggctcttcttgtccgatgagcctgtgaagctgctcgatgccagagtgtcaagagcggtagttccaccgagggcaatgagccaggctgtcgccatagcaaacatgaacgagaaggcggcagtggccagtgcttcaggagacaggcggccaacgatgaggatagacaaggtctggagactgttttgcagcatgtacgcgaggatgactgggatggaggcttttgtcaagaaccacatctccgccagccatcctttggtcttctcataattattctcatcagcggtcaccgtgctgattgaggatgacaacgaggctcgtggaagcaggcgggagctttcatccggttgagtctctatagtctccggtatgcccggtagctggtgtttaggagagctcatgttcttcaggatgattatgaggaacctaacacagaatgcttgtgaaaacttctgtgtaaatttgcgttggaatgtttgtcgtttttgcaagggtgaaacggcgtcaagccacagctgaaagatgtgttacaagctgaccgaggtcacgagggatgtgtgtctgaccaagtgcggtttttgcgtagttggtcttaaataaagcagttatatcagtacatattttcttattaccgaccgaaacgataagccagtattcgtcccccatgtctccgtcatgatgagtagctcagagtatgcatttatccagtataagacagcatttcgctcttctcataaaatgtctcttatcatgtggaaaaaggggggcaaatggggtgccacgttaattggatccgccgccgctagttcccatgccgtattacaaatgacgcgatgcaaaggacgaggaaatacaataccgatacagctctcagattggccgagtgatacttcgtcgtgtctgctccctagtggtggatgtagtgaacccgatagatacaaatatgccattggacgaagtggccgtttctgagctctcattcgacacggcaccttatcagacgcttaccccgcttactgctttaggcaacttaggcacttcgtggggagagaagaaaccgttcgaatggggtgaagcaacggcctcgatccctccgactcgcatcatcatggctaaaccctttcggggcaactacgcgcctcgcatatcagaacatcatgacaccctaccgacagatggacgataatgcatcaagtggttgaatctttagtcaaggactggttcgatggtgaggagtaaccggatgggaggagggaggagatccagttgctgtccattcatgaccacttccaattttaccgaggcggtacataaatactggttgtcaggactttctactgcatagttcttcatcaccttcaatttacacatatgaccttgtattggaaaggcagagatccctctcggtgttcttcctgttccaaatcatgcatttcacttctctccttgcccttggctgggcaacaatcgcctccgcccatggagatcacaagcagaaaaccatgtccggacctcacgaaggtctctggtacaatacccttcctggagacggtggcactcaggccgattctgtcttttctggcatctctaccttcggccgtctcccctaccagccctgcttgaacaatgccaatgtcaagtacgacattgccttcctcggtatgaaactttcaacaagagaagaagacttctacttgagagctaaccttcttccttaacacaggtgcacccttcgacaccggtacttcgtaccgccccggcgctcgcttcggcccctccggtattcggcagggctctcgaagattgaatctctagtaagcccaatgcctaccaatgccactacccccccgtccagtctgctaacatctcttagtggaggttacaatgtaccccttgctaccaacccattcaacagctgggctactgtgatggactgcggcgatatccccgttacctcgtaagtcaacactctatctcacggcccaagatatcgacaactgattagttttgtagctatgacaacacttttgcccttcgccagattgaagaaggccactttagtcttctttctcgctctcccatgaccgacgctcacaagaagggtcctgccaagagtggcaagactctgccccgtatcattacccttggtggcgaccacaccatcactcttccactcttacgatcaattaatcgggcgtatgggccagttaccgtcattcacttcgatagccatcttgatacctgtaagtcattgagcaccacacggaattattagattcttcattattttccaacgcctgacgaatgtgtctaacttattcgctcagggaaaccgaaggtctttggcggttctccctctgaggtcgcgagcatcaaccacggtacctacttctatcacgcgtccatggagggtctgctgtccaaccactccaacatccacgccggtattcgaaccaccctcagcggccccagcgactacgacaatgacggatactgtggtttcgagatcgtcgaagctcgagagatcgacaccatcggcactgatggcattattgaccgtatcctcaagcgagtcggaaccgagaaccccgtctacctttcgatcgatatcgatacactagatccctccgttgctcctgccaccggaacccctgagactggtggctggtcgaccagagagttccgcactattctccgaggcttggagagtctgaacttgattgctgcagatattgtcgaggttgctgtaggttgttccgtccccttatcttggaagcttgagctgatgtcatctatagcccgcgtatgataccaacgctgaactcaccacgatggctgctgccgatatcttgtatgaggtcatgagtatcatggttaaaaagggccctctgagcaagatgatcgatgctaacgacgagttgtaaattgcatacgttggtgcatacgttggaagcttgaagggacaagactttgggaagtcgccatgtgtgacattgaaaagggcatacaaggagactgtggaataggaaacgtatagtgaggaaagtcagacctcagtcttccacatcatttattgtacataggagagttgcaattgtcaaaaaggaaacgttcatttcattatcattctcatcaagcccatcattgatctgagtgtcaagctgatcaacgtgtacgtcccgcgtggtgtcataagcacaccaagattaacaaatattcagaaaagtacaatattgtactgaacttcatcttttggggatcgagagttagctcagacgttaccagcgaatcaagattgcttacttagaaatagtccggcacaaagagaaccatcaacatctcctcgatcaagcctaagcttccaaatatcctcgagagcttgcctaagcacacttacatggagcgacccaaggcaaacctcgaatttgtggattttatcgagcacaaaatctttttgttcatcgctaaatgcctcacagcccatggtaaaaagcggcatcgccattgcaacccaggtatggcaaggctgcccttgcgtcatgttattaatcagctctatcatctcggtcaatgcgtcttgtataggcgctgatccagagggcaagttgtaaagccttcgatataggtgaattaaagtcgcctgttgaaatatcttgttgcagagcgcaaagtctcttccggattcggtggacaggtcagaagatatggaaacgctcggaggcgcgttcatgtcccgagctatgaggcctttcactctccctagcagtatgtctgcttccaagcggatggagtcttcgctattagggccttggttggtcaactgaccaatccgttgtaaaacgcccagaagctcctcgctgtaccctaggaagccgtctattttggggtgagaagtcatctttgactcggaggaaatttccgcagccactgtctctgtcaaagactctacttgaggcagtgacgggacgtgtggtaaagtttgtagagaaaggtatagttggtacagatgcttcagcgcagattgggtaggtcctggcttggcgaggatatcttgaaattctttgttacttccaagaatcgccctgaccccctcgagatgaatgcgccacgatgaaactccttgtctggttgagaaaacatccgccaggcaccagatgatacatgttgatagcgagacctcgtccatttggcctcgctccaaggccgccctcagcagcgataagcctgaagattgcagatggacgataattcgagatacgtcggtgccgtctatcatgaccaaccctcgagaaagaaaccctgccgccgacaaggcaaggcctgcagatagtagatgaggcgaatgcagcattgcggggaccaaccctcgacaaaggtcctcatggatagagggatgacaagacaaagaagccaagacgtcttttgcaaggtaatccaagagcttcctataccgcgagggcatcggcatgccattgggaagactctgtgggatcaccgggagctgcgtgtgcggtagtgaggcagaatctcgggcaaggtcattcatgccataaatgaagtcacccccatcattgtctatagtgaagaaaggaggagttagttgggtctagatcagatgctgctatgtatacgggaaggcagagagcagaaaggatgtattggctgggcatctctacatattttagttgctggggggttctgggcttgcaggcaggtcccaaaccgagatttggaaaaagagcgtccgccccagaccagattcaaagtataattgcagacgcggttgtagtcgaaacagggaccacaggtgggcttcttctcgtcacactttctccgcctccttcggcactcatcacacccctgtctcgacctgttggccggcatagatggtgactagctgtcggggattggaagactgggaagcatcaagctggggagaaaaggggggccccatctgcaggacgtccatcaaggtcactgaggtgagcaagacaggtgatggaagagacatctatcacctccgtccgtgagcaagaagatgggttccggcaatcggatgctcccacaatttagcagtagtctgtccattacggttggcttcagagataagcaatgctggctgttgaggagtgcatgataagagcgcgcaaggggaggagataaggacaaacggctggcaattggccaatgagagtccagttgagtaatgtggtcgaacaatcaaatattccattctattctgcatcgtttttgccattccccaactggcactgcgtccaattcccatgatgcatacaacagatcatctaccactagttatatattctcacaaggaagatcatccggagacaatgagtgaaatatactcaggtttgccctcttgagcttgaaatttgtcatcgtttatcagtgggtcgcttgatggaagagctaaactcaaaggggaatttacatccgcctgtttgatggggagaaaaatgacacaagccaatcattctctagcacgcgaacaactgacacgaattagacttgaatttcgacacaatatcaaaataattggtctagtaataaacataatcttaagctagatattgtggaataattaattgtgtttcttgttattgtactttagtatcaatatcataatgggagtggattgatagccaaattgtttcttaccctcactagatttgacaggcagcctgatagccacaagattttcgtcgtgatttatatagaaacggcacttccgacaaattcggtgccaataagattagactgaggagatataaggtaatttgaagtttcaatcattcatttgtctattctcataccgatctcagaaggtcttttccaccagttctacccaagtgttattactattctggtttagggtaagggatcttgcacagacaattaacaaggtattgcgtgtttgtattctcagatcatgaagatcataggtatgacgataggaaacgaaaagacttagattctattccgctctgaatgaaacttaaatataaacctcggttgagcggctgtggagagtctagcattaggtcacgggaacgagaaactcacatggtggaagccgctataataccgcctcctggtttagcaaagaatttctcaaggtaaataacgtagcctcagagatttatgtttgaaagggattaggtagacagcatcggttgacctagcttaactacgtcgatttcttcaatggactggtcttttgtgtgctatggcccatgggggcagacttgactgggagtctgaagcccttctctggcagtacgccttatcttaagccaaatgattgattcgaatcattttaaaagatcctatgacagtaaaatcaaagatgatatgacaatatactcctaaaagtgcctaggaaatccattctgctttcgatcgccctctgcgcccagtaggctctttccaaccaatatgtgacttaccaaacttgaaggcaggggcaagaactttcaggtcttcttccaggccgtattctttaccactcataccccagaaatactctgggtgtttgaacatgtctgggcggactcgcttgagcgacgcatgcgttttcgcgaccaaaatgggcatgtcgtcaaagtggcgaggttgaaactctggatcgcgagcgagtaattcggtctgctgctcctttgagtgcaaaccaagctggtaataccacatgttgaattgcgtcaaactgatgtcaatgtcaaatgtcacgtcatccttcgtgcgagcaatcaaggcttggatggcggctactgcaccaaccaaacctgtttggtagtcagagttggctgtgacttaaggttagcgaacaggacgagaaatcgtggtctgggtttcgactaacgaaggagagggacgacggcttcatcgaggccaaggaactgcccttgcaggtaagataagcctactaaacagtcgcttatctgctgccagcccgatctataggcgagtggacctttgaagccgtagcagctctctcgcatgtagatcaggctggggttcaactcgcgtaaggtctttgagttgaagccaaggcgatcgagaaccccgggtcgaaatccatcgatgagaatgtctgctccctttacgagctcagtaaaggtgcgcttcccctcttcagttttcatatcaatgtttgtgtcccgctttccagtttgcaggtctggcattgttgctaccatctcaggcagcttgtcgcaggatacacgaagtacatcagcccccagaagactcagaagcttagatacagcgggagctgcgatgacacgagaaaagtcaataatccggaagcctgcaagaggttgataactctcgtggtcctttgtgtctggccaacctttccgtggtgctcgcagtggttttgaatcccaaagtggcacttgaaacatggctctcccatgctcacttgagaagaattcctcaggtgtgtagcagacaacacctgcctgtttgtattggtcgttggctacacgctcgatctcgttggattcccaatgtgagaccttttcgctatatatctcaacagcttgctcatgcgtggcatcaatatcctggacgcccatcattgtcatcgtaggccccgcattcatagaaccgtgaaggtggtaccaccgcccatcctttgtccggtacacgttggtcgtattgcgtctgatgggcttgctcatttgataaacatccattttgccaagctccgtcgccatctgtttgttctcaaggaaatgctttccaccaattgtaggaagcaagactgattctagatagagagtggccaaatctgtgttgacttcaacgtcttggtattcgatgccgtatctctccgcagcggccacatttgcagcagtggctactagggcagttaatgaggcgcttgactcggttattttcaaaggggtaagaacaaaaggcttctcatcgccaccgacgaacttgatcttcttagaagcttcaacgaaggacggcgggagaccaaggcgggagtctgcaagcagcacatcttgtaggatgcgcgaagcctctgagaatatggaatagtcgcacatcgcagatttagtgtgaaatttgatataaatgagaattggaaagaacatatgaggaggaaattcattaagataaatactttcaaggtggataacaaccggccgaaagacgcgagatcttgatgtgcaaaaactccgatcttgtccacttttatgtcgagcgcaaaactccgagatgacgaagtagggaattttagtgagccagccggcaggccaatctagtgtgggacctctggtacctgcgacttggaatgctgttgtcaatatttcgagctgttgagttgatcagcccgaatccggcactcggagttctggcccccggttttggttttccgggacttggaagctttcattgacgcacgtattcaagtgatcttcaaaacacttaaaactccatggattccgattcgattgtcccggatttaatttgatcatctttacctaccgatcaagtattgccaaagacagtgacaactggcttaacagagaacttcttgtaactgagttaccgatttttggcatcccagtctcttggttgaaatctctattacttaccatgatatcaaacatgaattggagagctggagaattcggctcacgacctacccgagttgctaactgttcaggctaccacggtatgaagcttggatagccgatttgacgacaataggctaatagaacgcacataggcgacccagctgaggaaatgtataaccaggccacgctcggcgatgtcgatttcataaccggtgactactttgcaggtgtgtcttccccgcctttaggggtaactttgtcttggcatgagtgtacatactaaatatgtcaagaggtcaatatgggcaacaatgcggaggccttcgcgcaggggaagcattccggctacgaggagacggcttggcaaggactcaaacagtctttgcccgtcatagcacagaagcggatcaaagtcgccataaatggcggtgcccttaatcctggaggtctagccaccaaggttgctgccttagtatgtatttgcaagaccatcaacgaatgataaaagctgagacattcaagacccgagaaaaaggatacgaattaaaagtcgcctacgtgtcaggagatgatgttctgcccaaacttagcactttcatgccgcaacagaaggaagcctccttgcctcatttcgactctcaaaacaagaatgttgtcatctctgatgaatccttcatctttgcccaagacggaaaggaaccgcggaagattgtatctgcaaatgcttacttgggcgctcattcaatctaccaggcttttcagaatggcgccgacattgtcatttgcggtcgggtttcggacgccagcccggtcattgcttgtgcctggtattggtggtcctggaaaattacagattaccatgaattggccggcgctctgatcgctggacacttgattgagtgctcatcgtacgtcactggaggaaactttgctggtttcgatgcgtttaatctcgacaatctcatcaaccctggatttcccatcgccgagattgctcaagatgggtcatgcgtcatcaccaagcatgaaggaacaggcggcatggtgactatcgatacgtgtcgatctcagctagtctatgagcttcagggcaacgtctaccttaacagcgatgttaaagcgtatattgacgatgtggcaatggagcaggttggagaaaacaggtcagttatcaatctaaacgctgagaagtctctggctgatcattcttcagagtccgtgtcactggaatccgtggtgctccacctccagacaccactaaacttgccatcttctataatggtggacatgaagttcagctactagttaatgctacaggctacgctacagacaagaagtttgaactttttagtaagcaagttcaacacttcatgggcgaagaggctatgaaagaactcgacatttttgaattccaacagtatgttgcctcctcacatcaaacgaaccctgatctcccttgacacgtgcaaaagaatcggcgttcccgcatccaatcctacaaatcaaaacagcagcactgtttactttcgaatatttgcccagtcaaccaatcttcaggcccttggagcaattgctgtcgctgtcagacatatttccttgaagcactactctggtatgtgatagcttataaatagttcgtacaactagagcttaccaaagactgttcaaggctttcacaattcgttggatatgcgcactgcgattcctcgagcttacctagcttattaccccgctttgtggcatcaatccaacctcagcgagcagtgtcatttcgtcaacgccgacggtacgaccagctcctttgacacatcgccacctccccgatttgagcagctggagcaacgcaaatcttatgacacaaagtctcctgcacacttcacgggcgatcttcgccaagtgcgactgggtgacattgttctagggcgctcgggcgacaagggcgccaatttgaactttggattattcgttcagacacaggatgagtgggagtggctccgttcttatatgtcgtgtgcaaaagttcaacagatgctcatcgacgactggcacccggacttttccattgagcgagtcgagtttcctaagatctacactgtccatttcgtggtctacggtatcttaggccggggtgtgagtagctcgaagcgtctggatggttttggcaaaggcttcatcgattatttcagggacaagattgttcaagtccccgtctctattttgaacgaggcagcgtcttctaagttgtaagtaatgatatgttttagctattcataagaacgatcccgctgttccgagagtcgtctgatcaaagagcacacccacgacgtgacatgaataataagattaatcagcttgtctgagtcaaatttgggaattcatccaatatgccacctacgttgacttgtagggggctcaggaaaccggtttgttgacgtaattatcgcgaatcggagttttggacctcggagttttgaacatgcaagacccggttatggggctcgaaatgccgaggcttccgggatcaacgaaagtgggggttttacttccttccattactcactcgcacggatttgttggtgcttggagatggaaaatgtgttcatctttttccctctttctctgggaactcaatcactggggggcgaggccggcggaaacagtcaaggaacagtgtggaagatgtatggggatcggcggagacgttttgcaaaggtgcggttctcttccagtcttctcgtgtggaagtggcagcttaacctagtcaaaaagtaggcttgtgatccatgtcgcaagaaaaaacttcgctgtgatgggatacgaccagaatgcactcgatgtcaggctgggcagctctcatgtcattatgctgacgtccgtaagccacaacgccgccgcacaagaggctcagtgcagaaccctccaagcacgtcggatgatgcctggggaaacaatatgggtatgagccatactggtatctctgaatcacagataagctcggatggctctttgaatatttctcctacagtggtaaatcgaccatattctcccgggaccagcgcccttactcgcgctccttcagcgaacagccctccagcatctaatgcagatcctcacacaccagctgcttgctcggcgagatctgatacagtggtgggcagcactggcgatatgcgatactttggtacattgaacccacttcatatcctgcgtatgtattcaactcttgcgtctaaccagtccatagggccaccctcaggggtttcacttgcgtccatcggcacaggtccaaagccagcaccatggacttcagtcccccctaagaatccttctccaaacgagtcatggtctgcatggacacactcgtctatgcaaagactatttgcaatgagaccagaggtccccttgccgccatggaaggaagctttctccctcgtaagcgagttcttcgatcaagaacaccaagccataccttgttttcaccagccaagttttatgacactattaggacagcagtattctggaaaatccgaccgaaatcctgcttggctcgcgtgtctgaattccgtcctggcaatatcccagcgtcgtcgtgtggaacggggccaagatttatcagaaaaagagaatctgtcatggagttatgcggctaacgcgatgggaaatcttttggatatcctcatgcgcaacactcaattgctctccgtccaggctcttttatgcatggcctggttcttcgtgggcacaccgaatcctcaacctagcttcatgctgacagggagtgccgtacgattagctcattccattgggcttcacacaagctacgaagatcgatcttgggattcggtcgaagtcgaaatgagaaaacgtgtgttctggatcgctgtctctctagattcagagctctgtctccgaacaggcaggcctcctgcccataatctccatgactttcatgtggaactgccatcggacagtttacacaacggcgatagtgatacaattatcatttccaacggctcttctctgaatcttttcaacgcacaatgccggttagccacgatacaaggcgagatctatagaaaactcttttctagtcatctaccatccacagacagaggctggatggttgaatctgtttcacgtctgacggaaaaactagaaacctgggcttcttcaacttctccgtctttcgacatgaatgaacccttgcaaagacctgaacaccaaggactaatgcgcctattctatgtctaccacaactgcgttattgtggcaaatcgcggtttagggcttcaatattggacatcgcgtagccaggtgcatttttctgctctgccttcgacggcccaggtttccattcaccgatgtttgaaagcgtccagagctattttaggcttaaacatggttatgtctctaggatggaggagctactattggtaggctttgctatcagtcgcctcgttcaagtagttctaactcggttctagggatgtcattggcataatctcaggggccatcatcattctttgtatcaacgccctccgccagcccgaggaacttaccgtagcggaagatttgcgtgctataagtggcacatctaagcttctcagtctcttggacgaagagaatcccaatacctatcttcgccctcttcaatcggcgtgtgagcagttgtatcgcaaagcccgagccgccgttaacgttcacgtgagagaaggaagcccatcgtctcaatctggcgatttctatacagatggtgctagagaaccttcgatagacatccatcagggctgcgaccggcttcagaacgataatgggcgccttcaaactccgagagactctcatatcactgaggctggctttggctcgaggaatgactcgaattcccaatgggggtatacccccgaacagccatttatctatccttcactcaccccatggagcatggatatgctaatggatgactcattccttaatttctactaaacaagtattagcattactcctactaggcagtcgcacctaagattgcttgggttatgtctgccatcatttaccataacgacattcagccccagaagtgtatcatcatttatccctcgacgccgaatcttgaaggaatacgaaggtttgtccttacggactggcgaccccatcgatcagaaaggctcttctccattaaagccttcatttaccttcgggttcatatgattatgaacagtgtgagaatatcgcgagtgtagggttgagtgattggacccttgttataattttagcactactgtgtgataagtactaaatatagtagacttgggatactaaaggacttagatctgtataaacggtattaagggagatatatgattttggagtaattttatctccaggtcggagtttagaaggagataaatcctgggcgggttcactacaacacttgcttaatacgaattcgctcgcaacctgccagcctctagccacttactagccaggggcttaaatagttatctttgcgtattcgtattcctctgttactaaaatgctctgaagaaatatataaattcaactgttaattgtggacttatggaactaataagctacttgataaatccgccggtatagaccctgcggagttaggagttaaatcattcaacttcatcagaagcttggacaagtcaataagatctaacagactattaatatgaagctgttgcccacgaaataaatatcattgtttcttccgtacccccccccctattatatctgctttccttatcacagtaacaagatggtatcagtctggtttattactggcgcatcaaatggtcttggcctcagcctggctctacatgttctgaagtctggccataacgttatcgccgcaatgcgtaatcctatacgctctgcagaagctgctaaatctatcgaagcagctggtgggaaggtcttccaactcgatgtaactcaacctcaagacgagatcttcaaggctattaagatagctgaagctatctatagtagaattgatattctggttaataacgctggatactctgtattaggtccggccgagacttttaggtgtgtagccttgatccagagaatatatactatttataattagaattcagctaatcaaagaaacttatagtgagagagaggttattcaacaattccagaccaatgtatttgggccaatctatttaactcaagctgtcctaccaggcatgcgatcccgccgctctggtatgattgttaatttgagtagtgttgctggtcaagatggtcttcctacatgcagcctctatgcagctagcaagtttagcttagaaggtttcagtgaagcactatccagggagatttccgagtttggtgtctcaactcttattattgaaccaggtgctttccggactaactttcttcattcgatggagactaatgagaatggtatatcagaagtataccagggtactgctgtagagcaggtacttaataagtttaaggctgcagcagggaaccaaattggtgaccctgtaaaggcagctgagaggatgtttgaggtgattataggagaaggagaaggaggactactgaagggtaaggttttaaggctggttctgggcaaagatgcatatagtagaataacagcaaagattgagaagcagcagagtgatttggaggcaggatataagatcactttctcaacagatctctaggcggggaatactaagtcggtaccctagtcaacagccctcccctgcaatagtttggtttttatactaaaaacctgctttttctaacccttataactagctagataaaatagataaaaataaaataaagatctttttaaaaaatgtaatacataattataaatattatatagtataaataactatatattacgcttcaaataactgttagggtcctggaagtataatttcttattgttgagttatctaggttatctagacagctgcgatccagctgatatacagctgctaggctgcttatataagcagggttcagccaacagctggctgatccctgccaggacccttctgaccataacaagtactgcctttcaagagaaaaaagccactgccctagtggccggactagctcttcgtccgaagacgaaacagctgtccgagagggaagggaaattaagataggcaggccggctaggcgtccaaaagagaaggaaagagaaaacagacaggccagtcagacctgacgaaggtgtccgagagagaaggaaattacagacaagcaggttacacaaacacaaagagggtgtacgacgaggcagaggtttgaagacaggctcttcgcacgggcgcaatacagctatctgacgaagacaaaggttatataaacaggctcttcgtacgagagcgattaggttatccgttgaggctattcgtaatcgttgtagctgtagttatcttcataatcattatagagttaattcctgtctacgaggggggggttggctaaatggcttgtacaatctgagagtcaagatgttccattgagtagtcacatcctacaatcagtgacagcaatcaagattaccattccgttttacgtttctagagtaataatagaacgggaaagaatgaaagggaatgcccgagagtaagctagcgaagtattggccgagccaagagacgtgtgggcgatcccttacggtgaatctatgtgtggcgtatgtatgtcttagttaggctgacgaagtcccgagggcattacgagagtcatttaagccattttaccctggtcttaccccccaaaactagaaagagtacatgctcattacatcacctgcatgcctacgcagggcggcttggcctggtcttgttgcgggcgcagggatgaggttgtgtccactcacatccagatgataacaatgtggcccaaaaaattactctttcgggaacgattgaccatccctgtctcagattgagttgataagctaaattacgcgatgggaggccgtgtctcattgaaaaaagtaagattcccctcccgccggcgttgctcattgcccattaaaatccagtgtgctcatgatggcttcagacgtcgtcaccatggctgtagactgggagcagttcgacaagaccgacatcctcttcatcatcttctgcagcacgatatgttggcagatcgttccgaccgtgggtttggcctatgccgggtactcgacacgccgaaatgccatgtccgccatctacaccagtctccttgttctcatcgtatgcaccatccagtggtatctgatcggatattcgattgcctatagtgatgggaatggactcttcggcgacctgagccatgccttccacattggcgccatctgggaaccaatgggcacgataccgactttgctcttcagccaattccaactgatcttctgtgctacggtcgcggccatctcaattggcggagcgtgtgagcgaggacgcttgctcccactgattcccttcatctttctctgggctacccttgtatattgccctctggcacacatggtatggtcagacaacggttatcttggggggttgggcgtattggacttcgcggggggcactcctgtgcatgtctgcagcggtgctactgccacagcaatgtctgtctatctctcacatcccctatttcgctcgagggcatcaaaagagcgaacaccatcgcacctgaagctccataagcctcataatagtctctgccagctgatagctatggccactatctggggtggatggctggccttcgacgcgggcaccacactgagcctgaacttcaagtccgtcatggctttcgcagttaccaacacatgcgccgcttcgggggccatgacctggagccttatcaactattgggagacgggtcgcttttctctcgattctacgttcctcggcacgctgtcgggcttggttatgatcactccagctgccgggtttgttcatctgggaagtgcattctgtctcggcattgtgggcgcgttgatcattagacaagccctgcggatcaaattcacagacttcgctcggaagctgaagtgggtggacaatggggacacgtttgctacccactgcattggcggttttgccgctactatctttacagggcttttcgcaagcaaagacgtggctgcgtatgatggcgaaacggatatcgttggtggagtgctgtttgatggcaacattcgccagatcggcatacagattctcgaggctacactgggatttgcctggtcctttggcgtttcgtacataatctatgccgttattgattgcattcctggtctagaagtgcttgccaaggatgagtatgattcccacacccccctgctaatgaatttactaatataagtcccagggatgtgttaaatggcctcgacactcgacagattgacgaatcaatctacagcgatcagtggagaggggaggaagactatcagccatttgaacggtcaatcagtttgacataaggtcggggtcgcaataatgacttgagttccatcgcactgtacctatgtacacttagtccttgacacttctaggatttagaggatgataggatcattcccaacatttactgttaaacttcccaaataggtgttatttcctctcgtcgaaatgctcccagtttccaggtttctcctctttccacggcttatatctccttgcacaaattaattcagtgaacttgaagggtcttggtagactccacaaccaacgactggctcaagtgtttctccttctcattttacatggtgatcttctctcaatcattctgacgatcaatacctcatagcccatggatgagataatacacaaaactcaattgacaagatgctgcaagttacaaactgcctatgtagcgttccaaattcctaaactggctgacaaactgctatcttggctcggtagcacttgtcatatttcagcaattagtggtggccccggaaactttgcagtacgtgccatccggccctgatccaatcttgctcggctcgctgccatttgagtttccagtgtagcggtcgcaagacttgccatcgtcttggcaacagttggtcatgacgcaggtgtcgccgtaattagtgttgatgccacaaagcacgccgccgtcgacagcaaccacgttgttcatgatgatgttgcgagggccgccgttgttggagcagttgccgcagcttcgcaccaccttaccgtaatcattggcgtagaagttctggatctggactgtgccccttccattaaactggataatcttatccgcggctttgaatgcacctccaccattgacgtaggaagtgccactggattgcttgagcgtactgtgcaatgatcgtggttagttggatatgacacaataacgcgcgtcgggagagttgacttacagggcgtcttcacaaacatcggcccaccagacgttgttgagtgtactggaatatttatcagtatatttcctaaaaagtctaaaagaatgatatcgcgtaccatgttcctttacagtgcacaccctcggcctgatcaggcccgataatcacgttcgagagggtagcaccgtcttccaacacaaacattgcgtcggcctctccggtttcgtcttgctctgcacagactttggctataattccagaatgcgaaaggttaaattagcctaacattgaagatacgtggttgtttttttctagtagtggttacggtgacttacgactgcgatcatacttcttcattccaccgtcaaaggagccagtcactgtgatggccttgctggtcgatgtggctccggcagaagcaggcaaggtcgtagtgacgccagttggaactgtgccaccacccccggtggtcgtggtcttggtcgtggccgtagctgtggctgaagaagcgctcccgctgtagtggcaggaacattcagcagagatcatactgggtttgttggagcagtttgttgcccatgatggtagagaggtcgttgcagtgacggagctctttgtgaacgttgcgcagaaaggagaggcagtagccgagttggacttgatgtagctagcgcacgagttgctggtagggttgaggcaccccagagccaaagggaataacaaaaaagtcgcaagagatttcatgatgaaagatgaactagatttgagtgtgtgtgtcgttaactttgagtgtaaggccttggcatgaaacgattttgagcaactaagttcagatgagggcaagattggcggcatgcgtctgatttatatttgcacgaaattcctcttccaatgttgtaattctacaggaaatatgatattccacttttcagctctcgatattgtcatgtcaagaacaacaagcgaagtgcctgaataggaaaatgcggaggtatgacggaaggagaaactcaagcaatagggttgcaacattccaccaatcctagcaagcagcctctcagcaatgaatacaggtcacgccaaattataagcatacttgtataaattagacttccacccgggtttgttccggcggagaatcctgccacacggatatatcggcgcccatttcatttacagcatcgtcaagggggccgcccttgatagcttatcgtctcactggttacatcttcattcgtggaagatataggccctggcggtggattttctgccccaaattatacctggatagatttatagcctctccaggaatcgatattttgcttcttcgatcacaaattagacaacatgtccatgttcggccattcaaggcgatatgtcatgtcaaggtccagcggagtatgcagaatgagaagccaaatctcgtaggtcgggtatttgacgtgaagaagaaagactattcggaaagtaaacaagtgatgtacctaggtacatgagaagaaacaatatatacaacaaaagatagtagccatccaaataataatccacgccattccacctagcccagctactgatagccgggtacctgcatgcctttttggggctgataagcctgttgaacgggccctgaggaaaggagtcgctcttttacttcattgtcgttctgaatggttgcacagcaggggcaccaaaaggaggtgcaacaatcgccacatccgctcccttggatgttgtactgtcctcggatatctcctcgcctaatcatggtaaagatccaactgcatccaatgacgtgtagcagaccgtagacagcacagtcgccattacacatatcaggggaggggtttgaggggtcttcacgtctggattttgtgcggccggcaactagcaacaggtagtaagtatcaagtaagtgttaacatggttcggcactggtgcaaggacatactcaggcagggcaagaaggtgcccagtagacaagatccacatccgcaaccgcagagactgctttgccatgactcagacattttggacaagggtggtgtggtttattggtagagctttggtgcttgattgctcgtgggacagggatcgctgaagtgtggttattgcgtcgaagtactgtcactgccttctgcaaccgcttgttgagaagatgggattgagaacaggagaatgggaaacttgagggtcatatataatgctggtgagcagttggtacgagtcccctccaaaaatacccaatccttcagttggtcatcgtcatggcacggcttatcaccaaaatccccacgcataagctcagactgcaggctatgctcagccctagagattagtccaagggtcgcgctcaaaaacccacttgtcattccccatccaagcagctgagatgaaagatgacactccagccttgaaattcaacacaatatccaaacaattgacctagtagtaaatgcaatatcaagctaaatagcgtagaaggtgtcattattttcccattattgtgttaaagaaacgaggtccctaccgtgcgggaaaagagctttggtgtgccatgttttatttgagccacttgcccttcaacacttattcgtttgctgtagggaacggtcaatctagagcaccgcatcaggcaacggcccattcaaaggctatacttgggcatctagtcccttcaataagaccaacccccctgttggcggcgcgggagttatatataaacattggcaaggctgatggcattccagtccaacgtactcagccacggccattctcggctgccagaccacgtaatttccctgtctctaagcccgacacgtttcatggccaacgctaggaaggacgggcaggcatccacgtccatgcagggaagattttgctgtcccggacaagtcgggtgacccatgtatggcttgtccatgccaaaataagcagcatgatgcgcgatcatccaatatccaccaaacgcgccaagggaacatcgtcatttgtgcatgcacacagacttgtgtaaaccagtattcttcccctgtagtcacgtcaacaactcccagatgggacaaaattgctcagcgcgtgacaattgagcatttcttcccgaaagaaggaaaacacaaaaagaaagaacgaatgaaaacatgggtagatggccgaacgacccttcacaccaaaattttccatgtcaatgaaaaagtccccctaataaatcaatcttacctgccagacagcaagtgggccttgaagacagggtggctaaacccctacgctgaagcttttggctcgcaatgttgatactggtttcagcatagaaggcaggctcttatggataaatgtagctttatgatcggactcttattcgatggattgcctggatttcatagttcctggacactcgcaagaacattagctgagtacatacatactgtgagccaggtcagctgtgagccggtatgttgcctttcagcaagtaatcagaacaaactaactacgaaataggtgagatttttcacccaaacaacagctgtgcccagtctgtacatatttttaatacaaaagagcctggttggtactatgtgggtctggtaagactgagaacggaggctttgtttagacagacaggggacggacattgagaataagtaaaagtgaccgtcttaaaaacaccgaccgcagagtcacctcaacagaattattgtagcagtcaataagaatgcttcctattgtgtcataatagccaacccattcgcgtatagtagctagtattatctaattgctcaataagttcttattgttacacgccattctctatcattctgatgatgatggcctgtacaaggaagttgagcagtaaaaacacatattcagtccctgttatcccggcgcccactttgtaaggtagctaagcaagtttggtctaaagagtcctaggctctgaaatactggttatttgggtggttgtacttaaggtttcgaagaaacggtggaaacctaataaatagctgttgctgtgtttgctgaaagtagtatttctggaatgccatgatgtgagatcggaactaaagcttaaggtcgattgttggtgtctgtctgggctgatttgataatccggtttcaagcgtattcacacttggagagtaacaagataagcctcaagatgcgggtaaaagaactaagaatgtttttacccttcgcccaaaatcagggcgaggtactgaaagtaattggttttatggccgctagacaggtcgctagagatggagcgctggatcgaggccttttcaaggtggtgggaacggctgaggtgacgcagccgacgagggagctagcggcttcttcaatgcccaagggggcctgtaaactatcccgaaggatcagtaggaatttctcctcgaactctattatggtcatagttgatggtagtttcgtatgagtgatggtttagcagtgattgatttgatggtactgattgctggtttgatggctgccagtaattacttgtatagttattaaaaaaataaaaaaataaaataaactgtaatcgagaataggtttatagtagttttgatttagagctaggttagtacttcccttatctactcttacgggcatgggtgtggcaattgtatactggtatgtatctacctagttcgccacaatgtatattttacaaacaactcgcgaattccgcatgaggcaagttgactgctcgtgagctttggaactttgatagattaaatgtggctttggaataacctatgcggctattaatggcttaagttcgacaaagcatttgaaaaccgcgtggtgttcgaaacaattggcataccattgtctagatcatctgaggaatttcatcagccagatatatattgagtcgccctgggaattccaactaactaatgcagcaaccgtgtcttgagaaggatgagatcgagacgcaaatctgggccatgaaggataacgcaatcaagcggccaagttaaaatcatcacatcgtaactgggtgctttttggtcgtttatctgcaagtaatgacaatcacatttagtgttctaagcaagatgatctgggatttcttaagagctttgaaggttattgaaaagtatagaataaaagcacaaacatcgaatctagaacattgttgtcaggttttgaaccaatcccaagcagcccaaatccttaatacaactaggcaaattttgtaatctattattcgtggtatcaagatattcttgttcttattttgtacatcccagataagtagccgttgacgctcctccttcaagcccaatctaggtatctggactaaacctagagctattgccgggaccgagacctgggccatatgtggaccataggtcattgggaagcagaaattaccataaaatcagccaggtaaatgggtttttagataattaagaagtccggataccgacacgtaagcatcatctctggtcgattgcggttagattatcatcatggtgatggcggtggccgcggaagccggtaagaagatttcattgatgctagaggaaccccacattacggaacttgtacaataccgaggccgagattatcgtgcaatcttgatctgccactgttgtcaagagcctccgtgacagggtctggctaaggtgaagatcgaccgcaaataggccggataatgcgttatcaccggtcgcttatcagaccgagtactgtctatagaaatcctcctttatcagaaccggtgccatatggttccggtaaactaaaataaaataactaaagtcagccaaagagtatcgtcaggatgccgatctctccagaagctttaaccatgactctgtcaggattcatgagtcgtgggcaacattgatgccgagttttcatatatactacgaagccactgacatatgctgggaaggctactatttcagcggagcctacgtatttgtacctgcagttgtgaaagcgtcatgccctttgttgctcaaccatggaagtgtgcttgggatgtcggccgatatgtcgacaagatcgtcatcaccggcgcctctgcgagctttacgtaccttgtaaataacgaagtcaccaaggccagaaacacgcggtttcaacttttttgtgcggctagtgctatcgtcggcagcattgtgcccttcactatatgctcttcttatccatttaatgaggctatccatgatcgattgggagagatcaatggtagctcgaagcaacctgagggggcaaaggatctgaaagatcttgtcatcgaatggggaagactcgattattaccgttcgttgcttgcctttgctggaacagctgtcggggtgagcggcttcttggtctagaatggaacagaaacggggagagtttgagattcagttatcagcgaaggtctcagacttgtacaaacgaacatttcagattgtcatatcaaggatatgcagatgaagtgtaatgaaagacagcaagctcactctgtcgtgttttgcctactatctgccgtgactcaaatcggtctcctttggcttacggcgagtcatcaactacaattcaagggcccttttatcagttgtcgaagtggtcttattttaaatggagggcatggagagcctagattacgtgaaagaagcccactgttttagtatataagcatcagaactatgtgattactcctcatcaccgaatgcctatcgtcttctctatggccgagatcatgcgttctccgaccttaattattattcgtctatgtgtcctaattcagcactttcttgtttctcttcactctgctgaaacttatgatcacccagagactgctcggtcagtcattccacccggtttctactcttaatttcaagataaagagaggttttatgccaaaaagtgcgtatgctgtgttctgttgacctttaatgtcatttctgattgctgatatatctcttgtctcttagaatcgcctttcgagaagagaccagccgtagggaattgcttaaactttctgcactgccagggcaagaaggcatgcggcgctggatgccatagtacatatagaggtcctagctaacactcgccaacacgaaagaaacaaagaaaggatgacgcctaaattgggcatcatgatactagccctccataccaaaggttcgtgatgcttgactttaggcgtcgcccattctcgctttatcgcacatgagggcatcatattcaatactagatcactacaagagatgtgactcaattttggcggccgagacctagatttacagtgatgaggtaatctggtgagtgacgttacagtgcactggcactgccttgctgtcttaccgcctcacaagtacgtacatgcgatggaaggatagtatgcccaattctccttggttagaggaattggtgtacaatttttgtttcctgtagcgtaaaagtgcaattggtgttgctggagatggaatgctatccccagtgtagatgaccgagtgatggctgccagccacaatgataccaggctgtgctgagacgagcaacaaacggtggcagttattcttagagccaagcaaaggctgtgaggcgattggctgtctggtaattcatgcaagactcaggcgagcaggaatggacttagggataaggctggccatacataagatctcttttttcaactctaacggacctgatatagcatcctctattggcccaacggcagagggacgtcaatcaacctgtcacagggttcttgggggccgggcgattttgtgtgccgcgcgcaaggcccttgactcactctgtttgctgcgaaccgccagcggattggccggttcatgtcggggagctgccattgtttgcgccgtagcctgatttaggagtcagcaggtgattttcgccggtttttcaaagcccagtcacattcgtgaatggcccccgcgattgttggtcctttgcgtgtttttgatggcggaaaaccgtggcagttgcctaacaaacacccaaaagtgccgttttcgttcgtgtcacgtcacgtgctgcgaccggcattatcttgaactctagaaccttcagccaccgtcatccaacattgaaccaaccaccagcaccaacaccaaggcacatttgaggccgtcgctcacatcgctcaatcgtgcaccgccgcctcccgcaggatgaccgccttaaccgtcaccatgactccttcgcgtccgtccctgcaacccccggcctgtgaatggtgtggcagcactaccaacctccgccgctgcacaggctgcaaagccatctactactgcagccagtcacaccgacaatcacatcatgctgcccacaggtccgcgtgcgaggccgtcgggagcgccttggctggtgtcgtcaaggaggaaattccattccgcgcgtccttcttcaatggccgccaccccaccatccctcgccaccatttgcctgaggcccggcggtacacagctgcccggcgctggtggatcttggtcctcctggagaaattcgggcaggcgggcgggcggcggcatgttgtcgagactgccctggagcactgcctggaggtgatgcgcgagaagcaggacgacatctccgagcttggacgcttcgtgccttcacttctgcttcgtcttggcagggaccaggaggcgtatgatttcatcaagtggtatgtcgcggttgagcacggctggggctggggaaattcgaggctgggatacttgggtgtcaaaaatgcagatgtgctcgagtatcccgcattcgagatggagaaccgactcgacacatggccaagcctacccagcgacttgaactacttcatgctgtccgccttgattctcgtcaagatgcgagtcctaaatgagcttctggatattcagaatacttttagggcattgaatggtttcatggtccctgagattctcggacttgtccaatctcagcttctcaccggggcccttaggtcgcgacctgaaatcctcagacgctctacagatgatatatctgccctgattctacattctaaaatccacatcatggctctctttgacgctgctgaacaacatcacccgacaagctggaggtcgatgagagggcaaagggtggctaatgcctctccagatcccgaagcggatgctttgtgcaaccgctcttcgtggctagagactcatggcgcacttaaaactttgaaccatgcggttgagctgcgagaaaagaaatgcgggtacctcaagtatgaatacatcagaaacaatggccataagagactggtggctaaggaagtagccacgtcggccctagctagttcatagttgctatgtagatttaagacaacagatcgaattgcgatgcaaaactgtcattatttccagtcctctgcgatggtgtctatcttatgtagcgaccactagcgtaatggtgtgctccaaaggcaattagatgtcctgcgacgggcgctacgatggccagatgtcacattagccaatgttaaccagcattgatatacttcgaaactgtaataatcccaagacttctccagcaatgacgcaacgtggactgccacgaggccggctagctcgtgttcctgaaatcgcgatttatctttccgaatgcggtaattcaccactgagactgaaaactcatggcaagaccccgagatgtacacgtaagatcgccctccagccaggcaacctatcatgactgaatatcgaatagactcgagagttgagcaattctaatttagtttgtcttttgttggtgatgaattgggtagtaccacccgaatagcgaacgccttctcgaatgccttggatcagtatataaatcatgaacagttccaagatgaaagcctgttctcactatccatcactagcattcctacagcttctattaccgaaaactcggcttgattctctataccgcaaaacctaagaatctctccaaattcccacaatgcagttctccgtcctcgccaccgcagctcttctgctatcttccggtgcatcggccacccaccgagtatgtcccaatgaggtttctcaatacgtttaaaaggttctaattcattcttcaggtggattatcgatccccgcaataccaaggcccccaacccttcccatggcgtgcgactcatgtgcttcgcgcgggattcggccaagttgtcattccctccattattacccagcttcctaagcctgagtgtaagtgaatactgatttagcacgtctatcaagagccctaactaactgttatatggtaggaagagacgcaggatatggccctttggcacgcaattagaatgtgacaggtttcactaccgcagggcaactgtagctcggccgattcatttaggccgagctaacacatactagcgctggaacgttagagatagacttttgaattcgaatagaaggaaaggcaaagacggcgggagcattgtgtcaagcgagccgaggttttgacctggtgatttaccaggtcgcggcgtggagtcttcattcttttttccgctttttagtttagaaattgttcattcattttatcttacaatcagcactacattattcctagaatccattatgtttttgattcggtccgaaatttgtttcataagggctctctccagcttcaagtctaaaaccactcttatcgcgctcgtatgaccatcattaacatatgttatgatgaattcgcttttctgtttggtaattccgtttttgaactagatcaaagatataatcggaagtctcaaattcagagttcaaaagggtttagtctaccgcctgctaatcgacgagtttcaaagaaaactgctagccaggaattgccctgaactaagatgatgcatcaggtggcataataatctctactcgcttcagactttgatcaatcccatgaagctccacatatgtctatatccaaaatggctcgacacgcatcttgcaaatccctgctagagattcgggccgctcaatacattccgcctccaactgggaacacatgcccggtaatccatctggacttttcagaggccacaaatagggcgacatcggcgacatcctctatggttccgaccctattggcggcacttgacttctcagtagccaagtcaatcaccttggccctaagatcttcgtccaagctcaaaggctgatctgtcaacgtgagtcccggtgcaacgacattcacagtgattccgctcttcttgcccaactgtaccattttttttggtcagaacatacttcgacatctgtgtgtctagaggtggcagaaacttacctcaacggcgagggatttcgttgtatggtccaatgccgccttggctgccgagtatatgtgcataccgggcacataagttattgaagacattgccccaatattgataattcgcccaccacgattcatatagggtacggcttcctgtatcatgtagattgcaccacaatagttcagctcgaagtcgccgagcaattcttggggctcatagtccataatactcccatgggatttgacaggaccaccggcattattgactgcatagaacttagccactggtccgagagaaacggagcctcagcgtgaccatcaagtctacccagaagccatgtacatacctaaaatatcaattgatctcgcgttgaactcggtcattgcgctctgaacaatgtgcctggctcctggccgactcgtgatatttccctgaacaacggctgcttttccaccaagtcctcgaaccttttcggcgaccttgtttgctcgggcggcgctagaatccgaaacatagttgatgacgactgaagcgccatgtcgggcaaatgcgtaagctacgccggcgccgattccattctcacgccctgaaccggttatgatggcaactttgccactgagtgagtactcgtcagccattttctctgtattcgtggggagggtcaattatcagtactcttaaaacagtaggaagctcgatctttttatagttggataccatacagcaactggattactatgcaagctcatgcaccgcgaagcacggtcaagtcagtcggagttaaactgatctattgctccatttaataccggccatatctaagtgtttggtaatactcgaaaaccatatcgacgcacccatagtatgatcttccgggcagatccttgtcccgtcgcgtatagcatagctgctgcattacccgttctggcatgctgctgctgtaattgcgaccctggtggcatcatatgaaccgcacaaccctgctggacccgtatgctgttgtcaaatcgccacttttcacaggtctaatctggctagtcttccgcagagctcgatttcggacttttgatagtgatgaccgaggccgagatttggtagtgatggccgaggccgaaatggaaacgggcagacgatgtgtgattgaaaatcatcgacctgttcgggacatcacccacgaaaagggtttgttgaccgacacataacgcccttcagtttaattcgaagcatgttgtcagcaaaaaccatttcaaattataaaggagcgctgagtatccttcccaaatgagtttaattaaataccaaagaagaaaactcatagcttgcttgataaacatcttcactgcatagcagactatcgactagtgccgaaaatgctggttctcatatctggtgccacgggaagccttggctttcggctcatcgacagtatcataagccggggccatcaagtccgggttgttgcccgccaccccgagaagatcagtgccgaaaggttcgagaagctcgagagttttgtcaaggcgacgtcgtactacgacatccctgcgatcgagaaggcctgcgccggcgtggacgcagtcatctgtgcctacaacggcgcgccgtacctgcagctcgatgggcagctcatcctcttgcgtgcggcggagagggccggtgtgcaacggttcctcgcctctagtttctgtggagattatcgaggcatgcagctaggggagcaggattcgtatgatggattcctctcttttgatgcgcaagcacgcaagtcttcatccatcaaccccaattatattttcaccggggtactaggcgaggtcttgtttgctaccaaggacacgatggatttctctaccaagcactatggcccctgggaccctgagaataagcggttcgaggtctggggaactggcgatgagaaatggcactggacttgtgaacatgatgccgctgaatttgcggcacaagtcatcctcagagacgatgcggccgatggaggatattggtgtgtgggctctgggaccgacagcttgaaacagatggcaaagatctatgaacaagttaggggtgtccccgtcaagttagacttcttaggttcagttgaagaacttcatgcactcgcgctggatggtcaaaagaatggatcgcccaaagcaatgtgggattacatcggacggttttactactaccatattgtgagtgggaggtgggatatgaaaaccttagataatgagaagcttggtgttcgggggacttctctggaagagttccttcgagcaaacccgaacatatagagcacctgatttaaagatgcgaggcagataccgagcaataataagccttaaacctcgcctgatcatgttctatagtcttattcgaacccatcgtatatcacccatgattagctggtaggacttcttttggctctctattatcaatcagaggtacctaaagtagtaactactgaatcttgtccatctatcacaaaccggaagcatgcctcatcacagcctatttgtgtacgccactggaataccagagcattacttgctcgggccgccgcgaactccattctcaagccatacctcctccaacttggcctccgctgccgcctcctccacgatctgcctctcgtcggcgaaaacgatttgatctccaaaagcctctgctatctcttccagggtcttctggcgtgtctccttgaagaagaaccacgcaattacgaggaagaaggttgagcatccaacgaagacgtagtaatagttttccttgattgttgagaaggccgccggcccggcctcagtgatgcccacgttgacgataaaatgggatgcggcagcaattcccattacctttgatcgtaaggcgattggcagaacctccacgccgtacagccatgtcgtgctgttcagcatgccatagtacgcaataacgaagagataaatccccagaatagcaaatcctttaccaacacggttatcagtattctggaactctcgctgcataacagcagcgtatatctggatcaaggcaacgctagcaagacctgtaataagcatcttacgtctaccccattgatcaaggaggtatctgatggcaaggcagttggatatgaaggcacaagtaccataaactccggacagcgcaaggatctggtgagattcaatgccgagcgacttgtacagagttgtttggtagtactgaataacgttgacaccggtcaaacttgtcatcgtttgcacggcaatagatacttgggcgtttgaattagcatacgagttgcacactctctaatacagagccgtgtacttacctagcgcgcggcgtcggaacaaccgaaagatctccttccacgaggtcacctctctttccttttcgtattcaatctgtgctttcatctgggcaaactcggtttgtatctcttcgggggtggagccgcgtctgattttaagaaattcgatgcgggctttgtcgactttcccggctcggatcaactggcgaggtgagtctggcatgaaagtggccaggccgatgaacatgatgacaccccagggaatctggattgccagagggagcctccactgaaccgctccatagggagcgtacgaacaagcaaagccaacccagttggccagcatggaaccgaatgcaatcccggcaccggaaataccaccaatgaggcctcggctttcagggcggctgatctctgagagatataggggaactgtgccaaccattccaccgacagcaattcctgcaatcgctcggccggcgaggaacattcccatgttgatggatgcggtttggatgacggtgccaatggtgacgatgatgcacatcaattgcatgaaacgaatacgccccaggcgatcgccaatagcagtttgtagcaaggaaccgatggcttctccggcgatctgttggattcacatccggatcagtgacacagtagaagaagggcaatagagagcggcattggtagatcacaaggagatgtagcaagcggcgcaccaaacaggccagctatgcgggaagaactcacgtaaagtgctacgacagcgccagtcaatccattggagggcttccccatgtattcaatccaactctgatgcgcaatcgtagtagtagcgatgcctgtcacaacagcgcttagccagagtcttcaggagagggaatcgaagaatatgatctccgtggctgcagcaaccaccgccgtcgctacagtagccaatcttccaatgctaacaagactgatgaagagttttacgaacctgtatcgaacccaaatagattcgtgcccagggccgcgaacaaggcgacccctatggtgtaccatccctccatggcgacgagtgttggaagcgggtggaaaccaaagatggaaagtccagagtatcgaaatgagaggagaaggaagtgtgtttgtcagaccgttcatcctgattgtaaccccacgagtacatatatatgcaaaccctaaccccggattctccaaggtagtgatcgacatgtgaggggggagggggtcggaggtttcaccgaggaaggtcttttccaggtggctcaccgaaccaccgattaaagttcgacagacataagttgacaaacaggttgagaatccaattatgaatgaaatccactgaattaaactttaatttacccatcactatggccgttattgtcaagaagtggttccgaagccgtatattgcgtgaaacactgatcagcattatagcttaatgggtcccatctgatgtcacctacctacttagtgatgatccggtatctcggggtatattttcagcgacgggaataagagatgggtgggatgcctggggcgagccgtgagatatcgtcacccagatgtgtgaagcgtgggggcagtcggttgttcggcacgaaacggatcgaccggccagattccaagggaaagacgaggtgcctgatggggttttgtgcggctatcatccggactgcgccttgagttatcgcgcgcagtcattaatcccagcattaacatgattcgatctatcaggagcggtggcttttcctagttacgcaaccgattcgcagacaagccttgcgaatttaaatattactatgattcaatggacaatacaagtaaattagaggccaaagttgctggcacacagttgcggacaaggaagattttaacccttccaggattcaagcaatagtccacaattgtctcgcatctcagtaataccatcttctattaccacatgatattgtctgtacaagcgtcgttccaagagttctggctgaccctgctagctattctctgggtaatgataagtaaggacaatcaggggtaggagtccaacactatcaacgctcatctttgtaagaatagaataatatctgtttccgaatgcgagatttcaaaagtgtctccctctatgctctataacatgcaaagcaggtcgaagttactaacttaagtttgacgggtgagagctgacttgatccccccaacaggtcgcaaagatgtgatatcaatgccaagactctaaccccatggatacccctcgcacctagagaaggtggcagtaaggccacagttgtagctagctgtgatgttacgatgggcctcacatttcatcctgaatgacatcgacaaggttcatgaaaggcgaaaacaggagagcgaattttaaaatgatccgtaagataagaaatgcattattctagtactcagctatagccaagcaagtgactccattggaactagctatgagatccagatttcactggattatttacaaagctaaagtcttccctccatgaagcgagaggactgggatccagaagtataacagagctactgctcaacaaattcagatttggtccttcctataggcagctaccaacttctggtagaacgacttcgcctttccttggtcagctccctcattgagcctagattgtctctggggtacatcaactcggtcaccgtcgagacccgtgttggtgacagcattctgttgcttgcccaggtagaagtcgggcatgaagaaggtggcaatcaggggcaggcaggctagcaccagtgcggtgattgcaatgtggccattgacatatgcataggctcgaatcgcaccctgtctgacggggtcggtaaagctatagttgctgcgcaatttggtaatgttggcatagatctttgcaatggtactattgtccaccttcggcatttccaggtgcatgcggtcaagcatctcgttggtccagatggcagacgacactgcgcttccaattgacgaacccagagtggaccacagcgtgagaagggagatgatagatgccatgtcctcgtgtggcaccgaagcctgactacccacacgagcaccgacgacgttgaaggagcctaagcagaagatcagttgcgcagcgatcaaccgagccgtatcttgagtcatgtggccgtcgctctgaactagcaggccgtacccaagcactcttgcgactgcaccaaagaccatcatggacttgtatcgatgtgttttcctctggatgagaccaacaatcggccccatgatgctgagacccatggttgtgatgcccatgaagatggtccattcgtaggtcgtccactctttaatgatgtagatgtatgaggacatgtacgtgttgcgaactgaagatgccatctgattgaatgtatagatggtgacagcggcgagaaatgtttggttcttgatgatgtgctttgtcatgagaggcttgggagcaaggtacatctcgaagagcacgaaggcgatgagaagaacgaaaccaacgaccagcatggcgacgatgcttgggcttccccaaccacccttggcgctcttggcgagtgtgaatggaagcaggatgagtgaaaaagcaaatccaaggatgataaggccaccgatatcaatatcgatgagaccctcataaaacaacttcatccagaacatgaaccccctcttagactcttgcggatcttccgtgaccccggctctcacacgctttgaagcagccatggtgaccatgcccattttttctccccgtcgctgcattgagtacagtgtgaagatggcggggaggagcaagaccgggacgatgatggcaaacattcccagcccccatcgccagttatcctcaaatccctcggcgataaaaccgttgatgggaacggtgacgacaaaggggatggacagagaagctccgaagaagcctcgccattccaatggtgtcaagtcgcctacaataatgtcactcagcaagtcgagtccagacttgccgaccgaagtgaagcaaagccctacggtgtaagccgcaaacgagtttgcagtggccgcaacgacgaagcccagaacgtaaaagacaagaatcacgacatatgtagtagggcgcgaggtgatatctgctaattttccgataaagggcttgctgatggctcgaatgatctgaccggcggtggtgacagccgcaagcgagctgtgctggccaaaggtggaactggccaaggtggtgaaaatagttgtggtgatgcccagatcgagcgcataggcgaacattgtcaggaagatggacgagcccagcagccacagtaatactttgccagacttgcccgactgatataagaccttgttgaaggcctcaactctgctcacaccgacctcaactcggacggcagcggcgcccgagatatcaggcactgagccacgatgtgaatcgcctacgtcgtccgctttgacggtcgcatcgattctttcatggctggcgtttggcgaggagtagggtgagcctgctacgcctctattgtcagaatgatgctgaccagcaccttgagttggcgatgacatcttgtctttcccggggcctggaagtttgccggaggggatgggccctttgcaggaagaggaggcaatctagttgctgcaaccgaagcgttcgctctagacagacagacgcaagggaaaggatatatacagtgagtgaaagtttttcttcttttattggataaatcttggcaagaatcgtctattttgcaaacccggtctttcccttggagcagaaacaacgcagaggggctcgcggtgagtgatgatgggccgatgaaatttcttccgtcgcggattgcagccttttccgcctcatctccctgtgctagtgacaacagaagcccatatccaccgtctagttttgtacgtctccgagagttagtgtcacagacggtgtgggtataggcagggatagcctcatctgattactgtgttgatgcgactctatggatacttggcaaggaaattcttgatgagcctgccaatgggggcagcttatcagatcttcctccgggccaaaaccatgcacctaattacccagtggcgtctggggggcaaggaaattcagcgcacatggccttgtccgagcgagcgtgtgggtcggaccacacccaattttaacacgggtgtcggctctttccgttgcctttcttcctctctattttgcggtcgagtaactgatattaggtcgtagatacttcccaccttgctcggcgtatagacgttaaagcacacatagttggctattcaaccctcatcagagtcagggaggtggatgatagtgagccattcagtatttctcgagagttttgagttgcttcttccgttcaaggttgaaagcgtatccgtacccccacacgcaagcacgcgggaataaaaataagtatgttcaaccctaactcgacgcttctgccacttagtccacacgccaatccggagtaccaacagtccggttctcccgcttgagagctttatcagccaaaagccccatctttaagtacgacaaggtattattgggtgttgaaggtattgaaccagtaacggggctatccaccagctctcatcattaaactgctgactcgatgtcttgggcggcgatgaccaacaaagaacccagaatgcgtcaaggagtggaaacgtgcgactttacgtaaatcacacggaattgataagcctacatgcctcattcaccttaccctaattcagctaaggctgatacacaaatagcttcattgctttcgtctgcagtttcgccacattttccttttcccattagtgggaaaaggacgcgagcaaccaaagaccaacagaggtaagttcgaaagccattgacgcacttgacttaaggcttagtgtttccacatgtttgttgggctatgtgtacatttgctcaagtaaaaagggagccaagattgcagatcgtgcaacaaaatcccgcaagcgacagtgctgacagcgaatcaatgtagccaaggagtgatcaattcttgcttctctaccgaaccccgctcatcgttgaagcttggcattaatagtatcatgtggttgatcccacctcattgccacccatgccccaatgactgagctccgatggctgctggtcttagttttcatcttacaagtagccagactaggtacactcgaaagcaaacttctcctagccaaacgcgattgttcagaaatgttctcaacctatcatagaccttttctcgctggccttgggctatttgcaagagtaacatgaaccgatgtgcgtatcattagacccgtacatttctaaaagcgtagatcttagtggctatgttctctctctaaaatctcaacttaggagagtctcagagagcactaaatgggctatgttggcaagaaaccgggtccaatatggagccatattacggaaccctgccactatacatagtaaaacgctagagcaggtttctgcttggatcaattcgacgagccgccagtagatgctgcggagtcgtccaagaccatgatcctggaccttctcacaacaacgcgtggcctagagattaaagaccgctgctgttgggaaatactcgccccgttctccacgtcttcagagactagagcgagatgatgaccgtcttcgccagtctaggagtaccttctcccttatcacatcactcgcttctagtgttgctgttttactgtcttgatcgtgttcaattgctgtcttgccgggcctaactaaacaaggcttcttttgtactataaaaaatcatggaatcggtcatcattcaaattgatacaaaggttgagattgtatgtgataattccagttagaagacagcgtcttgagcaatgatagaacacacttgatctatcacgatgcaaaccaactttgagacggtctagaccttcaacaagtctcttggcgccaatcggttccgtaattcttataaatgtcgaaatcaatggcttcacacgttgttgtctaagatattgatcaccgactatgatctaggatgcccgagaaatgtgagcttatcctcagtcaggatgctagccagctttcgctctcaaggttatctacgcatgcggcggacctaattcaatatttaattgataacaaagcaaactctcaaccagcgtcatcttgttcactcccggcgctctagcgaatcaaattttgaaaagattaccgagccgtaacaacttatcacaaacccgcgcctccaaatgacatttcgacaggttatcgtagttaagtcctgtgttcaggacaaagatcgcagcacacaagcccagccgcagagtcagccatcattggaaagccggcgacatccagtgcgtttcttcagcatcgcttcgaggaatccagaatatactatggtaacgccatagacagcactgcagtgtcaggaaatacctgcacggttgttgaaattagatgatagagggttgcgtccatgctgtcgtccacaacgtcaacatcaatgcttaatcaaggagcgatcagcctcgaggcgttgtatcaaaggcaaaccacaaaggcatactgaataccagaatatttctaggaggcatgaatccctccctctttcttcttcaaatcagtcggatggagcctcgcatctcgcccgttaggtcaaaataggcgaagaaactccgtctccgaatcacgagaatcgagcccgcagcagagacattcacgttgttcgttcaccggatgccgacgaagcgttacatccagtgtctcgtcttcattggcacatcgggatggaatggagtatcatccctgcagacaggctttcgcccattatgttcgaataagtcgtccatggtatattgatagaaaatgtccaattacaagcaaactacctatggatctatgaagactagaggagatcagatccccttgaagctaagaaacaggaacaatgtctgatccatccttgtatttcccaaatttcgataacacagtaccccaaatagcgctactaatgatagagggttggtcctcaagcgaacaacttcccgctcagatatccaaaaagaaaaagaaaaagaaaaagaaaaagaaaaagaaaaaccggccgcagcacacttttcaagtctcaccactgttccctgtccaccttgattgttcctacctgccgcacttgccacgattgggttggttggcagtcgtggttcgcttggcgggattctcggggtccgcatctgaagtcatcggggctccgcggccaggtctacttctttttaattcttcgagccgattgccggtctctttggcgttttgcatttttttcttcgcgtgctcgccagtccgccggtcgttgcgccagtcgttccgctaggctcgcagtccaagacattgcatccggatcggggccctgagcaggaatcccctgctctgaagcaagccgtcgcttatgggaacgcagttccctgccactgtcaccaaggctcacattgctagccagagggactccgccgcttttctccaaatcttcataaatccgattggctccgggccgcttgctgggtgcgtctgaaagcattgatacggccgcgggccatgcctgctcgaggcgttcccggtatcccttatgaacgtctaacgtacgctcggcagtgtccttagcggcactcgggcctggcgtatccgatgtgcctggcgtagccaccaaaggcaggtcggttaaacactccagaatcatgacgccgaagctaaatatatcgacggcaaaggtctcgtttccttttttccgcaggacctcgggggcggcatactgccaagtatgccctcgcttgactggcaaagactcagtctttctgttccccgtggagaaactcgccattccgaaatcagtcagacagaatgactgactgctgacaaggatgttgtcgggcttgatgtcccgatgcaaacaatccttttcatggatatactccaacgcggaactgatatccttgatcatgcgatccactcgaaacctccagtccccggatgcccgcttatgggagtcgggtagcaattttctcaaagtcgtaccgtataacggcatgaagatgcggagctcgtggttggtttcccaaccttgagtgtagttgtacacaattacgttgtcctttgtcgggaaatcgaaggattagctaaccagtcacgccaaagtgggcggaggagccatcagagtttacttacgtgacgcattttgctaagcgctcgtacctcctcagatacccttttcttcaaggcatcggcatggccgttgtctgagttctgaccgtgatctgggacttcgtctccattcttcaagagtgaaatgatcttgccagcataataattgccgtcttggaggttgatgtactgattctgtcagagccaattctactacactagcaaaaacggagcgcgctcgcgctgattgctgtgcccaattgactatatagcctgtcactgacaccaacacaccccttctgcttggcaacgctatacaactgccaaacaggtcttatagcggacgatcttatcctcatggagttccgctagctggcgtctagttgatcaggctagatcttataccactacatttttgcggtctcaccccagaatcgaacgcagggctctgtatgtttgttatatcgcaggaattgctaccatatcagagccaattctactacactagcaaaaacggagcgcgctcgcatgagaatacgatcacgggattctcagggatataaggggccacggatcccctctgtaattactagttagaagtaacagtctcaatttatcccttttacctgtgaatctggaagctgttggtggcgacaccaacagttatgagcccggttagcacgctctttacatccttacttaactactccttcgttatagccttataaggggtcaaagcaattgtactattattattacaaattgacaccttgcctggtagtctagtggttaaagatatctctaactattagccttccagtcaaggcggccagtttatagtaacacctcctttttgcgaaggctagggttcaattcctgcttttgctgcttttatttcttttacagctgctagtaaaagcagctgcggccggaggcagctgttatctagctgctgtaacgaacagctgctgccaacagggctgccagtagctatataagctaaatcaacggcaatccgattattcatcggcattgagcatataatatgttcaatgcctttgatttttgcctaatcaagaaggtcaacggttcgaaaccccgaattgatcaattagatcaccttttgctgctagcaacaggtgtggaaggaagcaaccgtcgaagcacgaacagctgctgcagacctaagccgtcaacgccgacccaactgtcgcaacaggatcaaccgtaaaagcaacagacggtccgggcgtgatacagctgtcgtgataagaacaagcgaaatctctgtgcgcggcttgaagctgttgtgggcgtcacgatagaaacaaccgctgccgctacgaacagcccggcgcagatatcgctgtcctgacgagatcaacagcgatccctttgaacagcccggacctgaagcagctgtctcaacaagaacagccgaggcagctgcgggcagcctgtacagttaacgccgtctgtatcagaacagcagctgtagcaggaactagctgtaagagtcaggattaaaaggatctactgagcccctgcgagaggtaaaacaacaaactgttcatctcagaaaagatgtcagatatagctcttccttcgagctacctttctgacctgaaaaggtcgatcccgaccctggttgggattgataactggccggattggatagaccagatcaagacaatcgctaataggcttgaaatctgggcctatattgatcctgataagtctactcaactgactgctccaacctatgaagaccacccgagcctagaagagctagctgacccttctaggagggaaaatgagtcagaaacagccttccaaactaggctcgatcagtttaatgagagtctccaagggcgggttatccggctacagctgatcacaagccaagtcgaaagccgtaaccgagaccttcgtagggactatgagaagaagaaatatagcctgctagctattctgaatctgatcgacgggtcaatctcaaaggaattacaagtccttctcaaaggaaaggaaggagatgctagagaacggatcaaggctctcaaagaccacatccgaccagatgatcagtacgagacgctagctgcaacaacagccttttggacacaggctagggccacaggcagccgtaactgggctacctgggcagatcagatcaaagtagcctatatccgctgcagccggcttccgcaagagccgatcccgaaggaactagcggtctctgaattcctaggtgctattagagacacctttccagccttttacgggccctggaacaaggaacgaaggacagccggatcagcgatagacccaattatcctcttctctaaattcaaggctgaagccctgatcaagaaaacccagtcagcctctctatcagtcaacgcagctaatgcagctaagcctaagagccctgaaggaggtaggcctaggggccgagggaagaaaagcccgatagaaaagtgcccaggctgtctaatcaagcaccctagggctcaggggactagtaactggtgggaaagttgctacgcctttcagaaaacctacggaaaagcccctaaccagatggttcgagactggactgttaaggaaggtataaagaagaacctgaagtcctggtttgaaaagcacccggatgagaagagaaaggctctcagttggaacccttctacagaagaaggaacccaagaggatataatccctggagagggattatcacaacagaaaacagcctatagccttggaaggctcgagctaggggccgatgagtggattgccgatcatcgcaacctagcttggtcagagatatccgacgatgaaagtaacagcccgacagctgtatcatggatctctgacgaagacggtaatgccctgacgccaggttcggcggagtctgatgaagaaggaagtcattggacagaggaatcgcgaacctatgaagatctcggtaatcgtcagacaacgatatcgcaggatctcgagcattacggtcagaaccggacagctctagcgacctgcaatactctgccaagtacagaaaagacacactattcgcagcctgcgaagaagaaagtagtgtcacggacagaggaatcgcaagctacggatagcagcggtcactgtcagacacaggagtcatcggttactgattgctacggtaaagcaataacaagccaacccccgaccaatgaagaggtcagtcaaggcctgacgacgaagctcggttcgagcgatagtcacggtcgaagccggacacagagatcgcgaaccaaggaaaatagcggtaataagcagactataaggcccggccccagcgatagtcacggtcgtaacctgacagagagatcgcgaacccgggataaggtcagtaaccgcgagacacaagggtcgcgcgaagccgctgcggccggtcaaaaggagacaacggcaccgcgggcagccgatcaaggcagtcatgactggacacatggatcacgaatccacgatacaacaggtcatgaagagacacacggatcgcgaacccacgttgaagctggtaacagcaagacaacgagatcgcgagaccacgataacaatggtaatcgtgagacagcgagatcgctgacttacgatatgaacggtaatagcaagagtgaagccactagtcagatcaacagcacccagacgaaagggatactgagaaacgctgttatttatgattcaggcgctaattgccacgtctttaaccacagagcgtggttcaaagaggataatcagttcgatccaacctgccgagacctagttgagtcaggtggacggataattcgtgtatcaggaaaagggatagcccgaattcgagtagaatgcccgggctatccatcaggaagaaaagtagctcttacagctagctattttatcccttccttacacgttagtctcgtctcgatgagacgggcccttgatatagggatcttctgggatcagacccagcatcagttgatctatcaaggacgggtttttgctgtattacagcagcaatacgatcaattcgtactggccgaaggaagctacgaacagctacctacccaagtaaacaccctaggtcggctacccaagccaccctcaaggggtgatggagacctatggcacagacggctaggtcatccgtctcaacgggccctagctaagctagctgttcagacagagggtgctaaggtcaccggtccactgacctacgaatgcgaggtctgcagtacagctaaagcacgaagagaggtatcgcgagagatcccgagggagctcccgcgaggggccggtagggcctttagctgcgaccttcactggggacctggaatagggtataatcaacaccgatattgggttttatttacctgcctagatacaggaaatcggtttatctatacccttaagaaacgatcagatatccgagaagccttcagaaggctccgagccctcctttggctgcagttccaaattaagataatccttctttggacagacggagagctagccttagttaaggaagtcagaagttatctagagccggaagtagggatgatcgtgtttatctcggcaccttcaacacccacacagaacgggcctgccgagaggtcaggagcggttgttaagacccggctgcgagctatccatcttgattcaggtctaccagacgaactgtgggttgaaacagcgaagctagctgtttatctcctcaaccggactcctattgaaaaggatagatcttggaaaacaccctacgagaggtggtggaattctgttagatcgaaatcaatgtggtcagaaatcccggctaatttgaagcctcggatcaaccacctaaggataactggttgtatcgcatatccgatgaccacggatgccctcgaacacatcaaatccaacaagcctctttcaattacagccgctagggcacacatcggttacctagtcggctaccgaggaagtcatcagtacctgatctgggtaccttcgaaaggtcgggtcaaggtcatcgtgtcagctaacgtaacattcaacgaagccgttacctatgatccggctagagaggaagaagcactgacctcggcggtaagagacgatcaagtcctgaccgacctagctgctgaagacctaggggtctcaacggaaggttaccttcaggatattgggctagatctaggttcatccaatgaatcgcagaacctcgaaccggctgtccaaggtcagatcagacagaacgatctctacagcgaagagcggctgcaagggattgataagatcggatcggaaggagaagaggatcacgaagatcaatactatccgacaccggcacctagcagagccgctaccctcgatccaatagaacagtcagaccggctaggcttcgcagtcagagaaaccctcgaagctatgccggatgatcctgacgaacacgaagaggaagaacagtcatctgatgagattatcgttgacctgcctgacgatcatcctcttgctctctcgaacatcgggctctcgcgattatcccggttatcatcaggtagtcggaacacagatgaatcgtacgagagccgagagtccggtagtcaaggaccggataacacaaggagccgtgctagtgatcgcggtagcgaattaccaagcctaacgcacgggcacgatgaatctgaccgcaacacgaccgacgcaccgataggtcagggatccgaagaaggatccgactatgaagaagaggcagcttcatcagctgacagtgatcgtgatgatcgtgatcaacccgacccgacggaaggtcagggaagaaggtcagggagatcaacccggcagcccgagagactaggaagctgggcacagccgatctctctcaaccgtaggcaacggagatctatcgcatccgttaccgctaggttggcgtgggctagccaacgccggctagttatgtcagtgatgaacgcggctgcaaggcatagcttacacatcagaaacatgccaaaagccccaaccagttggaagctagtccaacaaagcccctataagaaggagtggataaaagctatggaagcggagatccaagcccaccttcagaagcagacgtgggaagaggtattgctgagagagatacctagtcaagatctaattaaggtcaaatgggtctttacttacaagactgatgaagccggcttcgttattaggttcaaagcccggctagttgtccgaggagacgaacagtggcccgggcagcaagaagatacttacgcagccacattagcagctagatccttcaggatcctagccgccctagcctgctcgaaggactgggaaagccaccaatacgacgtggttaacgccttcgtcaactgtgaccttcaagaggaggtgttctgcgagatgccggcaggatttactaaaaacggctactgcctgctgctcaagaaagccctgtacgggctccgtcagtcacctaagctgtggtttaacctccttaccaggttctttataaggcacggctttcagcaatgcaaggaagacagctgtatcttccgacgaggaaggctggtagtcttcttctatgtggatgatatcgtggttctgtatccgaagaccagctcgacagactgggaacagctccacaagcagctgtttgagacctttgaagtcaaggacctaggtgaaatgaagtggtttctaggaatagagatcctgcgagatcgtaagctaaaggaactgtggctctctcaaaagtcatatatctcgaagatagcccaccgttttcatctccaagatcaaacccgaagaacagaggtaccgctaaccgctaagttggctagccacagtcatcccgttgaccctaagatgatctggctataccaagctaaggtcggaagcatcctctatgtggctgtggtctcgagaccggatattgctttctgtgctagcaagctagcccaattcctaacgaatcccggccctcaacaccatcgagcagcagaccaatgcatagtcttcctttaccagacaagggaccgctgtatccgctataccggataccctcaagataacacgttattctgtagtactgactcgtcttttgctgataacaaggatcgaaagtcatctcaaggcttcgtcttccttctctttggaggcccggtaatttggaaagcctcgaagcaggctactgttacgacctcaagcactgaagcagagctgctagctctatcagctgcagtagctgaaagatatgccctaggaaggctcctcaaggagctagggatacagctagataacccggctgtggtctggtgtgataatcaacagacgatccggctcgttaacgcagacctagcccggctgacaacgaagctgagacatgttgatgttcacaaccactggctgaaggaaaaagtggctagaggagaagttcaagtcaactggatgaaaacctctgaaatccccgctgacggcttcaccaagccgctgccgaaacaagccttctataaattcgtaagtcagctacagctaacgaatcgacctacctacctataggtcatctacccggctagctagcggtgaggctagctagcaataaaaagcttaaactatagtataattagaagtatatagaagattaagtaatatatatatataataaccagattaaataatataataattagagatatagaaattataagaaaattaaatagaaagtattagaattagtaatatatagtaataataatataaatattactaaactatatctctaataatattaataatagaaggaagaactataatatatatataaagaaagagtatcttctctaactaataatacagatagtagtaatttagaggagttagaaataatctctactaataaaaaagaatagagtatagtatataaagaactaactatactagtactaataaataaagttaaagaataaataaaaaagttttaatagtatttatttaaaagtataatataactaaatatcttagaaaaacttcttttctatatactaataaatataaactagtataaataattaaaaaaataaattaactagataaaaaataatctaaactatttataatagaactatagtatagtataatattaataatagattagagaatcctagaagtaatagaagctaaaagctctatttatattcttatagagatagagattaaaaggaactagcttatagtatttattaactatagagtataggaaaattatattttactaatagtaattaactaactttacttactatagaggaagaagaaaaaaatctatatagtagctaatataaaaagcttaaaatttaaatataataatagaattattaatttagagactaattatcttataattaaaattaaaagaaaaaaatttaatattatatataacttagtactactaggaggttataatattatattagaactactatagttataagatataaacctactaattaattagtatactaactatatagaataataatactcttctaaatatttaaattagaattaatagaaattaaaattttattagatactagaaaaatatatttatttatagaaggtttttattaggaataatatagatttaatattaatctaatatttatttatatatagttatttatactatataataataattattattattttaaaaatcttattagaaatattaattagattctaaaaaattagaatatttatattaaatattataattataaatatttactaaatatttagtaattaattaattaaataattaatattttaaattaaaaaaagaaaataattattattattaaataataagctttctcttttagaagctataattataactagatatataaataatctgattataactatagcctctaaaagggaaagcttattatctaatagtaataattattttttctttctaatttaaagtactaattacttaattaattaattactaaatatctagtaaatacttatagctataatatttaatataaatattctaatctcttagagcctgattaatatttctaataaaactcttaaagtaataataattattatctaaagtaatttaatatagctatttactaattatatttattatatattcctttagttagttaaaaacctatttataataataaagctacttttaatattatagatctaatagctatatctatttagtttattactttattatataatctatctagtactactatagatatttataaagaataaaaactaattagaagaaaaactatatcttaagaataactatctatttatataagcttattataatctaatatataacacgaaggaggactgaagggagcagtttcattacgacaaaccatcacaaccatgaatactacctaccgtcgccaccgttatcaaaacacgttactaccagcattctcatcatggattatacttgtcatcaccatcttcatcacgattttgtttcccatactgttgtggaggaaatggggtaaggtttaaagggcggagcaatgggtgtttgtgttcttgggcgagttattcccatttattttcttttttcttgtttccctgctgccctctacagctggctttctcttactctcttttcaatcgcccccgcattattgagagaaaagcgccttagatggatcaatggatagtttaccgaatgacaacaacttggtttagccgagcccacctaaccgagggaatattgtttgttccaaggagagcaaggtatgtatgtacatacgtacatagaactagatataaacaaagagtatagattcctgctgactacttagactaccgttacccacatacgtcatcagtgttggtgccggtactgtagagagagtggcgcaatagatcagatgcttggctatagcgtatttgcagagagatgcagctagggtcggattcataggattatttatctcttctctccaaatagcttgcccaaggaagaattccctacatatagcttgggcttgagggatccactgacctttcgaccgtgatccattttggctactgacaagaagagaacttcatcaccagtacacgacctgaatggcagccgatagcgactgttgattccattacggcagatgcagaggctcgatactccggaggtagccaaaggatactcttcccatctttcacaacccatatattatcactgctaagagcataaccagggtgactaacgcctcgtggagcggtctcactcgactgataaccgataacaggcattagatccgggtttaaaattccaatgtcagtagaggggagagggccatgttccccgagcatctgtaggcatgcgcctattcctgcatcccagatcttgattttcttatcacccgaactcgatgagagccactggccattcgctgagaacataactgagtatacccaactactatggccctcaagcgtctgtaggcatgtgcccgatgctacgtcccagatcttgattgtctcctcgtttgataccgacgcgagccgctggccatctgccgagaacacgaacgagtctactggagagcaatgttccccgagtgtctgcagacatacacctgttgctgcatcccagatcttgattgcgttatcacgtgaacctgatgcgaccctctggccatctgccgacaatatgactgagctcaccccttcatcatggccctcaagcgcctgtaggcatgtgcctgttcctgcatcccagattctgattgttttatcatgtgaacatgatgcaacctgctggccatccactgagaacacaactgagcatacccagctactatggccctcaagtgtctgcaggcatgcgcctgttgttgtatcccagatcttgactgttttatcaagtgaacctgatgcgacctgctggccaaccgctgaaaatgcaactgagcttacttcttcatcatggccctcaagcgcctgtaggcatgtgcctgttcctgcatcccagattctgattgttttatcatgtgaacctgatgcaacctgctggccatccactgagaacacaactgagcatacccagctactatggccctcaagcgtctgcaggcatgcgcctgttgctgtatcccaaatcttgattttctttccacccgaaacaaatgctagcctctgaccatccattgagaacacgactgaatgtaccctgtcgccatgaccttcaagtgtctgtaggcatgtgcctcttgctgcatcccagatcttaattattttgtcatatgaacccgatacgagccgctggccatccgctgagaacatgactgagctcactatctcgttgtagccctcaagtgtctgcaggcatacacctgttgctgtatcccagatcttgattgtcttatcacctgaagctgatgcgagccactggccatccgctgagaatactaccaggtatgtcctgtctccatggcccttaagcgtctgcaggcatgcgcctgttgctgtatcccagatttcgattgcgttatcacccgaacccgatgcaagcctcttgccatctgctgagaatacgaccgagcttatcccatcactatagccctcaagcgtctgtaggcatgcacccgttgctgtatcccagatcttgattgtattatcgcccgaagttgatgcgagcctctgaccatccgataagaacacgactgagtatacccaaccacaataaacctcaagcgtctgcaggcatgtgcctgttgctatatcccatatcttgattgtctcatcacatgaacttgatgcgacccactggccatccgctgagaatataactaagtataccccgtcatcatggccctcaagcgtctgtaagcatgcgcctgttgctgcatcccagatattgattgttttatcaagtgaacccgatgcgagccgctggctatccgctgagaacgcgactgagtatactgaatcaaaatgaccctcgagcgtctgcagatatgcacctgttgccgcatcccagatcttgattgtctcatcatatgaacccgatgcgagccgcttgccatctgctgagaatacgaccgagcttactgccttgctatggccgttaggcttgcgtaggcatgcgcctgttgatgaatcccagatcttgattgtgtcatcgtctaaaactgatgccagccgctggccatctgctgagaatgtgaccgaccttacccaatctctatggccctcaagcgtctgtaggcatgcacctattactgcatcccagatcttgattgtctcgtcatctgaaactgatgcaagcttctcgctatccgctgagaatataacccacttcaccccctcgcggtggccctcaagcgtctgtaggcatgagcctgtttctgcatcccagatcttgattgtcccatcaagtgatccagatacgacccgccggctatccgctgagaatacaaccgaggttacctctccactatggccctcaagcgtctgtaggcatgtatttgttgctgcatcccatatcttgattttcatatcatccgaagctgatccgagcctctggccatccgctgagaatacaattaactttactgggccactatggccctcgtgtgtctgaaggtatatacctggtactatatcccagatcttgatcgttttatcatgcgaacccgatgcgaggcgcttgccatccgctgagaacacaaccgagctgacttcttcactatggccctcaagcgtccgcagacatgcatttgtttctgcatcccagatcttgattgttttatcatctgagcctgatgcaagccgctggctatccgccgagaacgcgactgagtgtactggatcgctatgaccctcaagcgtctgcaggcattcgcctgttgctgtatcccagatcttgattgtctcatcatatgaagctgatgcgagccactggctatctgctgagaacacaactgaatatacccccccgctatggcccttaagcgtctgtaggtatgcacctgttgctgcatcccagatcttgattgtctcatcatatgaacccgatgcgagccactgaccatctgccgagaacgcgactgagtatactgaatcactatggcccttaagcgtctgcaggcatgcgcctgttgctatatccaagatgtcgattgtttcttcatgtgaacctgatgccagccgctggccatccgctgagaatacgatcgatatcactgaatagctatatccctcaagcgtttgcaggcatgcacccgttgctgtatcccagatcttgattgtgttatcgtatgaacccgatgcgaggcgcttgccatccgccgagaacacaaccgagctcactgaattactatggccctcaagtgtctgcaggcatgcgcctgttgctgcatcccagatcttgattgttttatcatctgagcctgatgcaagccgctggctatccgccgagaacgcgactgagtatactggatcgctatgaccctcaagcgtctgcaggcaagtattccagtccgaccccatgctcggctttactgtaatccagtccggctcttcgttcttgaaaagctctctgactaggctgcgagcaggactaaatacaagggctgatgtatagacctgcaacggagcaatctctatagctggcttgtgagaaagaacgaagcggtacgcatcttgaagcagttctgttagttgtcgtgattccgtccttctctatcaatatgtcagaatatataagaacgtctcaagtgtgcataaagtcgcatcaactcactgctatattctggagcttatccactgccacgaccccctctgacatactgcgtaacaagctcagacattctagccagtacagatacttctctcgtaggaagtcatccacaacgccaccttcctgtaagtccttttctcttgtttcctctgcgggaccggagttgctgagatggtcaacccagtagatacaaggatatcggatcgaggataatgggtcagggcctgatgttgaggtttgatcaatagggaatcctggattgtctagactgtaaatgttacgtcgtaacgtattggacagagcctttagcgacctacagaagatagcatgatgcagcggcatcatgccatctggtaggatcttatcggatgccctattaagcagaaaatctctggctgattgatgcacaatgtagataatatcttcccgaagtgtcagaaaagagccacagtacttaatgatctcctccaactcgcccttgtcgaggtcctcgggcgactcaatcagaaccttcagttcctctagggtgataggccgatatacaaccaaaacgatagccaaggcttccttgcaacggtccgcatcttccgactcgtcgatgtgttccatcattcggctatagagagcatcaagtcctggagggaatgacttcaacctagagagtgtatgccgttttcggatcttaggttctgcgagctcttgacaaaccaaggcgacccacaggaatgtaccgtcggcattgcgagtcaagtaacgttgaacagcatcctttgtttcctgatcatacctcttgttctgcgccaactggtccaccttaaacccgatgtaaatatcaacagcattggagaccgagtactggtttaactcgaggtgcagcctggccttatgcctcgtattatccagtttttcttcgatctcaggccagttgcgactggatataatccacttgacgcgggatgaagaaatcgaggaagattgaattatgaaatccagaagctgggatcgaccgctactgcactcgtcaagagcgtcaacgactaagattgcatctttcaaggtcggatcacctagtatatccgtaaggatcccagccaaagatacccagacatttataccttggaacatcctttcacctgcgacgtcatacttagcccgaacatgtgatataagtgacggttgctggacggcgaggaggtagataaggccgcgcagcacagacgttgcattgttcagttgagcctctgtggcctgacaaaagaaataggatagtcgaaagctgggttccttctggagctcgtcgatgataccgcacagaagcatcgtcttgcccttgccaggatcgccattgatccagagtagctggctctgcgggtcgtcacgccatcgctggaagtcgttgttgtcgagaatccagcggtacgagtcccggagcaggccgccctttgtatcttggatgcgcgtcttgtcatcgcgagggtcagtctcatgcaggtctttcagacattgcttgtccctgtcatcctggtgtctcctctcctgctgctgagtttggtcctgaatggccgaatggatgtcttgaagattcatctccatagtgctggcgatgtcggtgagtttccggaatcgttccttgctctcttccgtattgtattgttccatatctcgttgcacagcagcctcggcttcctgaatctcgctgagctggccagcccagtcgtcaagtttgagcatatcccttccgatgactgctgcccaattgcggcggtaaagacagacgcttttcatctgatacgagagcagtttctcgtagagctgcacgatgtgtttcctcagttgaacttgtagtcctgtggcggatgaccgggccttgttctcgtcgagaagcagggacaccaagttccagtaccactccattctcgacaggacgtaggcgatgcctttgcgattgtcgcgtgactcagtaacggggtttgaaaggatctagcatccgttagtgggagggtcacccaccgccctctgcggttccgaaagctgatcatacacacctctagtccaaggcagacgcctacccaggccacggcggcttctggggcagcttgaaccgccttgtctactattgcccttatcgcctgcaccgcttgcaagccttcgtcgatgcctcgcttgatggacacttgcttctgcgtccgatccagcccagcatgaaccagctgctgcatttggtggcatcgtgtgtctcggctgctcatttccttttccgtcagttcggagtcaacagagctcgagtcgtttcggcggagttcagctgataagatcctctcgtaagcttcgaccagtttaggcccgccggctttgagctcgtcgtaggcctgattccaaagtcgctcttgtaagcatggcagcggcaacacttcagaatctgtcggagagggtggagaggtcgtcggctgagacgtcgatcgagtcactggttcgcattgaagctgaggcggggaaggtgaaggtgatggtgacgagggagccagggtagagtctcgagaagctgcctgccgtggcctgataaccttggatttggctttctcaagccagtgaggtgccatttttatagagaataggacaccttagtctcgttgcgcgatatgaagatatcagggagacggcttctactcatcaacgagccgggatgaggatggagtgctcctactgatggcttaggcagcaacatatttgcgggatttccatgcggtgagggaggcgtcagcagctgaaaaagacccctgtagctaggcacagcttgtgaggccaatagacttgccgactgatgggatgtgcagccgcgccaggtcaattgcagggctctgccgtgtttgaagtggaaagcgcaaggcaaataagcgaggtccggcaaacagccgaagcgccgcagatgatccgtgacgccctactttgccatcttacgtcaacataaccagctgtccccaaaattctcgcctcttcctcctcaacctctatttacattcgcttgccggattttgtggatagtggtcctaatatcgatgtacatgcgctcttaggctcctacgaggcgctttcctcgtctctgcgtccaatatatcttcaatcttgacagtgcagggcttcgtctagttaggtcaaggaggcgttcgtgtcacattgtcgaaagcctcggaaacgatcaagaagaagcaggctaaagagacacagtctcccctctccaaccctttaccgtctctggttccagcctgcgcgatcagcaactctagtgacttcctgtgtggtcacggtagtggccatgggccaggaatctggctgttgtattggacaagaggtgtgtgtgtgtgtcggcgtgagcgatttcggtgtgcaatgtcttatcgttaattacctggttgcctaactagagcaattctccactctcagctcgaccagggaagccaccccagctcaatctctatggcactccccttgactccccaaaacgggagtttcgccccggagtcatcgcggccgtcaccctcgccatcactgctcctgtgccaatcatcattatatgctccccgcagagagatcttatctcacttaaaacttctactaatcaaacttacgttagggggtcgatgctatccaggatcccgctaaagaagagcgtacttcggcaaccctcgggttaccgtactatcttaacgggttcgcaaaaattagtatccctgtaatttccacttattgttgcgggagcaaataggagtagtagagtttccgcaattgtcaagcccctcccctataataaaatttcgttccctctgcaccagcagtttcatggtgtccctgacacgcatcatccaagagctaaagacaatctggactggaagaatacgcgcactgtagcctcactgagagttagacatgcacccccgtggttatgcttgctaacccttgctgagattccaactatttaatagaaaaccaaccgaaaaaaaaaaccccccaggctcctatttcatttagcgtcttgagggcgtttatatgaacactgagagagtcttttctacaaaacgaaggacttaatgctacggaggtagtccagtcaactattgcaacaattgcctgtagttttagatataataatctgatgataagtttaatatagccagtatattgacatatttagtatatagatacgttgcacgtatgagcatgcccgatgcaaaactactgaggacgtagggtaatccagttccactgatccctaatcactttcctgctctataaacttaggcgttgcagaaacagagctggccagtaacagccatgggggtacaagggccacaagcccttccacctttgtagcagagcttcccactacctttagtagcgcggcaggtacctttgctagcgaactgagcaatgttagagagggagaagctaaagataaatgatacaaggggctggaaacatacgcggcggaaaagatcacgcttctcaatgtactcatcgcgggccataaggtactcctcgtgagcgatttcagcaacgtcacggcgctcaagatcggcatcgccgatatgggccacagcaaagctggaaagagcgaagagagagacaatggtcttgacgaaatgcattttgaaggatataacaaagaagtgtcttcgaagagaacaagatttcgagagaacaaaatttcaatagaaaggagatgtagtaaattgatggtttataacttcctttattgatgctaagtgatttggcctcaaatcggtggaggaaggtgaggtttatatacttttctctctttgatatcctcttcactgttactctctgtctagaagcttgagatggagttttatctcgattgggaagtttgacaatcttcccctgacatgcttatgtagtggattcattgaggcaggcataatgcgttagcaggctaatattaaaccttcttgtcatgccctaagcaggggtcgtcctgacctgccataaaagtggtaaagacagcggccagatcgagcgcaacactttgtataatacttacaagcctagttctaagctatatactgttattgtattactttttaacatccttagcttaatactagagctaaaaccttttaagtaattttgatatcaccagcaaatcgcctcataactagcagaatactcaccttagattcgggagcaggtagaaggacagggctaggtcgtcaaaggatcaggaaaagtcttcagcctatagagaacccgttagagatgctggtatattatcacaaggtaaggatgttaagtgaatgctaactctactattatccaatatgctttacgagctcagaacctagcgaaataataaaggcctatagttattagcctctcatggaataatgcggtgatgggtgaagcccttcctaacacccagaacagaatctgaactttccaacatataagctaagggctatactaagcacacaacagtaaaccaaaacttgcaggagttcccatcggctaaaacttacgtatcgcttgtagatcgacgtatttttagaatcagccccacgccttcatgaatcatgcgctcctaccggttaccaaaacaagcacgtgctcggtagaccaggaacttatttacttactaagtacagattgtgaccgatccgggccacgccgtggcctttaggtgtgagtagctcacttaagtgtttttttgtggagacatatgactactaataggtggtcaagtcaatgcaaagctatttacagatataactatttacaaataatatgtatacgactagcctggtactaattcttgaaggaagctgagagaaagagaatttagtagaaagggagccaatacgaaagaagacacttggcgtttgatcaggaaatggcaggattctctcactctcttgatcgtgcgacttggatctgccgtgaacctacctggaatattacagggctattaaaaaatttgacaggaatatggcattgataggcaagtaaactctggtcagagggcgtgtcgatgcacagccaggcacctggtagcagattaattagaaactactccggattagtggaatatggaatgggattgtttaataattactgtatccagttatccggggcaagactagtcaagggtttgtggactggagggtgagtaccgatgaaagattgacgtttattagtcgcatgagaaacaaggttgatgagcagaggcatggcaaagggccctcatcccatacgccatgcgccctcggcgccatactccgccggccattttaaagtctggaaggaggcaaggggcaccatggaattggcgtcatgatctgttacgccccaaggatttgatgattgggtgactcggcaaaatgtgtaaggctcaatcaatcggcttacaacagtagctcgcgagacggccaataatatgcccttgacctgcgacagcgtctcggaaactagccagtagccgtcttccctgctccttgtcagccccctgtgcccatgcatcaacgcctgctctgtgccggactagggtttacttaggattttactatccaaccaccacacttcactatttggccacccaaatgtggcgcggtagccgatatcgcagccggtgtggctatcacacccaaaatagctgtttttttcaggggtcattaccaagggggttttcaacgcaacaacacgaaggtcacaacagtcagacacgcaggtcttgcaacgaggctatcgcgatagggctattagggctatttctattcaaatgtggtgttttttctgctgttcattgggggaggaatttcgggtctgataggtcgcacgtgatctcctcctgtgtctcctgctgctgataaagatcatcccaattatctaacgaatcctcctcttcatcttcagcccgaacttcgtcttgctgggcaattatcagtatatcgaaatccgccagggtttcatgctcagcatcctgtgactgtccaataggcccggcttctccgacgacgatgacagactcgtctggaggtgtacggcaacgagaggcttgtgccttgcgaggggcctgtgttccgggctcgagggtatcaccaaattgacgaatgtacgcaagaccggttacctgtggtgtttcgagattggcaggggctgttgacggcgggaccctggcctcgagagattcggattcgatcgctatctcgtgtgacgagggattgcgacggaggtttcgtgttttatcgagattgagggagcctacgggccttccttttcctcggactgtgacgggctcgaagggcactgtctcctgcattcgatacgacttccaaatccaatgatcgtcaaagtcatccaaggtcaaggtccggccgttagcaagccttgagtggataatatgacggcacggaagtccccaggcaacagctttctcgcacacacagccttgtgagaggaagaggaggtctttgcgaggctttgcctccactgcccgatgttcatcttcaaggacgctcaacgcgtatgctgtcacttgctcacgaattggcagatagatcggtttgattgaaaaagttgatatcttatgacgctgaattgactgaagatttcgaatattcttaatttggcgtgaccagaagtcgttgaaccgatctatgatcgaatcaaaatcacccttcgaagaccagaggaagcgcttcatctgaccgtggagtgactccacgatcgatgtggttatatgacccaggtgacgatgaagattaacgagataggtgacgaagcgttctttccaaggataaagccacgtattgaggcaatagtcaacgggctgcttggggtggtcacgtatgaagctcgtaagtcgactgttgaaggttttctcatctcgcgatctcactaaccgaccccaatcgcgaaggaagttgacgaaggaagggtctcgttcaacgacgttgccgaccttcttcgcacccggaaacatgcccttacacttcgcaagaacattcatattgatatgccaacggcagagaaggttgatacattgggcaagacgaggttctctttctatcccgttcaatagggcgagttcgcgatccgtaaccgtgatacgaggcatagggatatcgtattcttccaagacgtcaaggagggtggaaagagcccacttgtatgtagcctcaacttcgttattcaagaagatcgaggctactgtaaagctcttccttgtacccgttacaccgcagatgttcaataacggcatgttgaaccgattcgtcttgtacgtgcagtcgaggaggaggacatccggatgcttcttcaacagctcgagcccggctattggggagatcataagggatgtcagccggccgtgagggtcacagcggtcgcgaaagacgaagccatccttgttaaggcggttatagagatactgaagaggtgagagcccgttgagccgtttttcgcgatagcgagcaatgacgttggatacgtctcgagggaagatgtcagtcacggtctggccaacagcccttgccttttcaatctgctgatcaatatagacagtaatttgtatcggcgacgatccggctttatgcattgcaatgatctgatcttcgaaccgcaaaatagtctcattacggaagcttgaaaaagaagaggcatcttcgaacgcgtggttgtgtgtggtgttttgggccggttggatgacgaaggagtcatcagccgtagccttgatccacaacttgaaagggcaggaagtcttttgcgaattcgtagaccgccgcttcgagggatgagtctttggatcatgacaatcgttatacgccctggccttgcagcagcttaggatacggctgcgaatacgtccatcctcgtgtctcttggtgttgcggatgatgagtgcaaagccggcagctttggcgactttatcacacgccagctttgcagcctctgcagaggtgaatacttcattgaataagctatccattggtgaaaagatatcacgaaaagcttcaattttggcagagttatcgcgtgttcaataatgcggcgttgcgacgcgttgacgttattgggttgaaaacctccttggtaatgacccctgaaaaaaacagctattttgggtgtgatagccacaccggctgcgatatcggctaccgcgccacatttgggtggccaaatagtgaagtgtggtggttggatagtaaaatcctttacttagcgaaccaaatcaagtacttatgctgcgagccggacaaggatactgaaccggggtgaataggacagggatgatcaacagttttgatacttgacactgcaaagggtgtcatgtcaacctgcagccagtaacttcatacagaaaactccccagctccgtgtcagacaagcggggcctgtcacctctttccctggatcaaacagaccggataatttcaaatttctcgtaatagctggctgctatttttactcattttcagtggaatatttcttgctagtgttttcccaagagccaaggcctctcgctaattaccaccccccacgatattttaacaagactggaaacgcaggacttggcaatccataaacggttctgaggttaattagatacagccagctcgcggcaattgctcctcgaaactccccccctgtacatggggttgaatccatggggtggagccacgacgtcagctcaacccccgagagatccgcctggtattagcgtaggaatgtgtgaaattttctgaccgaatgcgaaggcgcgcctacagtagcagccgtgttcccgtcattatacctcaatttggcgtccctctgtaggatgcgacattattatcataaattccttcatgaccctaccctgtatgatttccaggaaaattcgtggcagatgcaatccgcatcacaggataacctgcggatgaagttgacagtcgtatgtagccttttgctaacatatcatcaatatattcgcggagcgtttgcaactgaggttccgtaaggttgtaaagtttgtgaaaggctggttctcctccttcgatgatggagatttcgtgatccactggctgtgttctgccaagccagtttccagagtttccttgtacagtctatcatagactctgtattcttctgggatattcttcagtcgctgattttcggctcctctttctccaaatactttttcctgtggtatttgtgccatgcgtctgaatctttgttccattgtgccttttcttgtgtcgtcattcggctccattcttggatgccgatatctgcgggttccttgggcggcttctccgtttctttttgccatcggttaaccctgacttcgtattcttgtcgttgttgttgggtcatttgtgcccaatctatgtctgtttctggtggcctttctattttttgtatccggcctaaggttcgcgttgtccgtcgtaattcttgccgagacattttctttggtgtaccaggttgtggcgccgtcaaggctgtaaccactgcatccacttgtcgtgagtcgtttcttcccgtttttatagtgtgctttcagttgttgaagaaacatcatgttcttctaacttctgacgaaatttcgatttcttttgatcctgatataggttcttaagagtgtccctccactctatgcggccggcgaaccaatctatcagtgggtttgcatctctgcgccaaggtagccccaatatgacttcttgggatcctagctgtaccaagtcgtaggtgacatcaaacttctttccgtggattttagtcgtgaggtgatcagtctctgagtcgacaatcccattgttgtactcgaattgtgttccttcggcgctggcaattggatacggttcgttctttcgtttccatggtaagcggggtcggttaatcaccgctgtaattttccggcgctccacagtctatccatgctgtgagccggttcccctcgatctcaatgtccacgaggatgttgagcgagctctgggcgtctattgctcctagggtcctctggttcattgtgccgcgctgtagccccattacaggtggtttttgtcgttttttgcctgattgactcgttgttccagttcagggtaccagttcgcgttctttggtatgtacgagaagagttcttcaagggtgctaggttgccatgcatcctttggcacatattggtggaacttcttcatccattcattgacctcgcatagttcggttactgatgctgtttcttcgtcgtccgaatggttcttcgcccattctttttcgtcggtggaggttattccttgttcatccgtttcgctttcgtcttcgctgtccgtgggagatgatacgccttcttcgcggcgttgtcgaagttcttcttcccaatgctggaattgttctagatgcaatttggcggcatttacgttgtcgtcgccgtgtctggccaggtccaatgcttcgtgcatggcttccaggtggtacatacatgcccaatcgtagcaccgtttgatctggcgctcgcatctccatccggcttggtcttctcgattcttcttctcatgccagagttcgatcttggattccggtagatcctacattcagattctcgacataggtcggtaggtcctcaatgtcacactcagtggggtattcttccagatcttcctcaacaatagtgtatcgttcaaccattcgtcgtcttattttgaagcatcgagtctacttggcgtgtatctgggaggtatcttcccatctggccatggaaaggtgtcgtactttactttttgttgccagtgtgttgtacaccatatatcgtagcatgtcatccacgagtcttcgtaatgatcttccttcgtctggtttttcaagcagctgggtatttccgctagagtgctgggaaatctgataacatcgatggttcttcttccgtataccacaagtacgtctgtgttgtctggattctgttcccgaatccttttttggtggtacgcatgggcttcttcgtgttctgcctgtatggcatttctggcctactggtagcgtgtttcttcggcaggtatatgcgggataagattgttctcgtagcagaatacttgttcgtatatcgtcatgggtccgtattccagattttcttcgttgtcttcgtacctttttcggatattctggaatttcttgtggattcgtttttggttatctttggcgacactgcgttcccaccgttcttctggttctaataccttcgtaagaacgggtgcgagtaatacggtaaattcaggaatcttcatgcttgcgatggttccttcccgagtgatctttctgatcattccaagagtcttgtgtctcggtttttccgattactcctagttgtttcttgccctccttagcaggtttccagtttctctgcttcttgggttttgggcattggggtgcaatatgtccagtatcgttacagttgcaacactttcgtttttccacggctcctagctccatgggacctgcgtgcgtcccagagactgcggttctctgtcgcggatagtatcgagatttgccggtattggcgcgctctggttgcttattttcgaggcttcgccattgatactgccggtcgtcaatatgtactgccatggttatgtagtcatgaagactttcgggtctgtcttccatgtacagttccttcctgacttccttcttcagcctgtccaaatagtgggacatggcttgtttgtggtcccatcctgctctagagcctagatgcagtttagaccgcccgacaggccagatccagactcgggcagaataaaccccgtctcatgcagcccacgtcctcagcggtaaaaagaaacgatagttcggccaagccggagacctgtgctttgagcccccccccccccaataagaagatcacaaacgagagaactatgagatccaccgtactgcccacgccttgccatgctattcttctcctggccggcacgcgtcaatacccattgcttaagctcattcgctttggcttccaggattgggggctgtaactggatgcactaattaggccgtgctccccgacttattaaaaaaatttaaattttttttttttttttttttaaatctaaactaaagtagggtggtcctttttgtatgagatgtccctgcaagctacctagctcggtaggctgctaggcgctgtctaagttctcggtactaactcagtttctagacacatattctggactgtatgggtagagctgtaaaccatatggcaagcgatatctaggcttatctaaattagaagtgtttaaacctagctccacctgaagatagctcaaagcctcctagcctagccttatgcggttaatgttcagatgtgcagggtgtccatccctcttggtttaggttagtttaggtaagggcatacgcgaatctgtctgacgctggctcgcttcttcccttgtttgggtcactccttctctcgttcagctcccccctccgcctctggtaaacgctgcagcaacttttccgtgtccgtcagagcactcatagcaccgcctgagagggtagaaatcgaatagtaggtcggtgctagagaagcatagttagtttaatatcgatacaagtctacgatcaagagttaaggggcagcggattacttaatggttggtgttggtaccgtcgcgttgcctgtgttaacgatgctcagaagccggaggttgagacgtctacaatgctttgcagtaatgtgggttccacacgatgaaccatttcgccactttattaatccagcggcaaactatcggctcggctgaaagaataggtagacagcccaaactcctgcttccggtaggtagtgttggacagggctatgttcgccattggacagattccgaagtctccttctcaatctcggcattcccagggggacagctccttcagaatcggccacaatccaactgtaatttcaagtcgaggctcaggattgccgggcttccgacccaccttcttttccgtctcgtatagttgatctccagtatttgcatttgtctgcctctttctattgagtaatagcatgcatttgtaatcttgagacaaacggcaccattgattatagttggataagatatagctggaacatatctttaaaccacacgtttagcccgaatcacagttcaccttatccggatctagattgccgggatcagctcttgggggcaataaagcaaagtagcgacacagcatggtacggagggagaaagaggatctcgactagtatgcttgctgatgatcagcattgaacgcgccagtgcaagaatataaacatgtcatcattcagtaatatcattaataaagaggtaggggagtttgaatgccattatagtgcatccctattttcctttggtcttccccatgtatcaggtgaagtcatagcgaggtattcctcactctcggtcggacgtggtggttgatccctcaatccagagtgattccccaacgtgtttcgggacaatctgaccgtgtttcgcacgcttctcctatcatgtaaaccctgcgacgagttttcctctccagacttgttgctctttctcaatccactgtgctgtgtgatgacactaaaccagcgtacgacggtcttgttaaatagcggctgtagagccgtgctggaggcgaccatctgcgcaattcccgcatggataatacacatcatgtaggacttgtgaaagtccgtcatgatgtagtagagatatagactggacaaaatgattgttctgatattcgttagtttgctgagttcctgccttccgagatctaccacttacacaagaccagcacaaaacatgcaaaaaagggcaactttgtgctgagcccgaacctgcagcttcaagatcggctggagcgggatgagcaggataagtagctcaatgggaatatcgatgatggggattgcaccgtaggcagccttcttgtcgatgcatgtcttctgtgaggctttgatagtcgaatcccaggcacttcggaccggcatacaccacagaaactcaatgaggccggcgtagatcgcccagcaaacggagaggccgagggcagtccagcagaggggtccaacaaaacgagaaccctgttggaaaatgcgcttgacgaggagaataatactcattttgacgcagagcagggtggcagcgtagcataggcgcaaagggagcatgatccggtattttatgatgatcatacttgcgcctgttggtggtccgacggcaacaactggaatagagtaaaaaaaccagtcagaatacactcatttaagcgattggccgatacctgcatatcattgcttctgctcttcgcctctcatgcagtggtgttacatcaaggcttacgggtaattgcacagccagcgacaccatagaaaaacaactggcccataaagtagatataatcctcagaatagaatctgaattttccgatacggcgagagataatacgcataatagtccaaattgtcgtcgtcacaatcatcacggaactcgaggctgccattcgtagatgtcgctccgaccattccagccggcggaaaagagctggggagtccgtggccgcatccatcgtagtagggaattggtccatggtgtcgatcgagattcgctcgccatgcgcgaacctggggccgagggagaatgagaccaaggtcctgtcgaggctaaaacatatatggagagagaagccaagtgaggcctcgtggtaggaagggatcagctacatattaaattgttgactgtccgcaaaagtaatcacatgccaactgaattctcgccatcaagctggcctgatgttagtccagcattcgtaaaaaatggcttcaggaggcctccagaggagggactcgaggtagtcacgtccgccgataggcagctcatccgaggccacaacctcgtcggcgcggttcgtctacaattcgttaggccagcgtactttgaaaaccatgacggagagcatgcaaaagtccttggtatgcaaagtgacctcgatataccactgtcaatgcatgtatacccttttcccgaaattgatgagtgggacggccaatggttcttcttcgacgtgcagctacacccttacgaactacacttccgccgtaaagtcgcggatggagatgagtcagtgatcggctcgtgggaaaatgtatatgggaagctggcacaagtccgtgggcaaatgtgtctccaaccgtacgtgccatcttaggccgccaggcctatttatttatggtttccttttcctgaagactaattgttcattacttcagggttgcagagaggtccctgaggcttggaggcggttgcttccctactatcgcgccacgctctagcttccaaggaccaatcgatacgaagaccttcaaattcaaagctggctcaatatcggaacaccagctgaagtgctgcggcttcgtccaatgtcagacctacctgacgcccccccgcgaaaatgaatcgcctttcaagggtggccgaccattccacatattagcgtacatgccgtatgaccaacagccatggaagagtcggatcggctggatgaacagttcagccgagggcggctttgtatctaggaaatggatgtacggaaggggaagtattatcggcgtgcttaacgttgagttgttggagaaggagcccgagcccggacaggacatactggtcgtgctcgttgatgagtttgggtttatatcaagggcaacattcgatagcggcggcagcaagggcaacgatctttcaccccagaagccgaggcaggagccaggtaaggtccgaaaccctttcagcagcagcccgactggcccgtctccgagaacgcagaagccgagggagaagtcagtggacagaacggcagaggaggcgataccctcggcagcagcaaggcggctctttggatctcaacaggagtccaccggtttgtgttcccgagagtatcaaggaagaaatacatcgactaatcgcggatttagtaggatctacatcagctacatcggatgacacactaggccagtgcgcaggtatgtgttctcaatgggctgtatgccgtagtatggggcttggcttaactaatagctgcagagcgatcggtcacggtgtcaacagatgccgaggaggatgaagcgtcagcgcaagttaggaatagcctgaagcgagccgctagctccgttagggacggaccggccaggaaaagagtgagctcgtggaaggtgcaggatgcccgagaagccgtaggtcgagaataatgtaaaacagaaaaacaaatgattagcttttcagtgtaatttcaagtgtattcatggcccgctttgtatctcattagacaccgagtgagcaaagcataaaacttaggttaggtaataagaaaataagaatgaggctgttgagctatattcgcaagcttcttcaagatcgagataagtacgaagtgcccgttctccatgattctattcgcctggggccaggctccaggacaaaagatttcggctccacgattttggcccaagtccattgagagaaaatgtatggccaagctgtggcgtttgagatgtggcgttttaagtggcgcggtctttgtggcgcaggtggcggtgttccaggtgttggcttttccgagggggcggaaggaagagcctttcgttcctcaaggcacacctttcggaactacgttccttcaggcactacgttccttcaggcatagtcctgtgatgctacgagggtattcttataattggttgctgtgctgaagcgcgtacgatttgccaagcgtttacgcgagcttgcagtatggccgccctttcccccctcatcatagcagatcgggtcaaccgttcaatgtgaggtgtgtcgcgagcggatgtaaggcggaaattagagaagcggcatttggatgacgtaagtgcatagtagaatgtactctgtacctgctgcgatgtcccaatatttagtcgcatttcgttggccttggtcgcagctggtcgcattcaatcgtatttgattgtatatagctgcatttaatcgcatttgatcgctggtgcttattgcacaggttaaaggtattggtgtgatggttgattacttcctaaaactgggctcggcgggggttgagttgagtcccaattcttggtagcgcggccaaaccacgggtcgaggtgccaagattttaaatcgaagccaagtcttaggtacatcgaacacagcatatcttaattaaggcctgattgtacatgtgtacttatggactaagccattgtccgggctacaggtcaacaaattggggagtgaccctatcaataccacaagtaagctagaagccacattggtgcgtatgatgtggaccttggtgtctcagcctttcagacgtacgaccggccgtccgtccatcgaagcctccaaggatctattttctgctttcgtgtctcatccctgcgtgggtcgccaacaacttcgcgtccattttctgctcctcgtgtccaattccccttcccaattagtattaggcctaatatccaaggcttatatgagccttttgtgtatctttcgctctcagcatttcttaattactcctggtcgtttcattgacctggccgaccttttcggccttttcgcagcagcgtctcactgggttcatccgcccttacacatcgcttacagatatcaatagctcgtccctagacatagagctggtcatgaacaagcacagataaataaaagaacgccttaattatagaaagtcactctagatatctagatagaagtactattaccatcctcctttatagtataatcggccggcggttttctcacagggcgtgggaatgatcttccctttgtcaaagaaaataataagtaagccgtagggattgacatttcattaggctacttacaatctcgtcaatagaggccgggaacgatgagtcgctggcagagttatactcataatacctgttattccgacgcacaaggagataaacatcaaagttaccccgaaggctaatcttgtcgcatctacgtattagccgctctattgtcctggtgagattctcatttgagcgatctctcttagcaggtagcggcttatgttccatagtcttgttttccttttggggaagaattagttagttagcaatttggtatccaaggttgaattgctagatttgatagctgcgaggaagggggagggcgagcccggtgttatttaaccccgactcagggcctgttctgggctggtaccagttctaggaccatagagctccatgatcttggcacacctagtcagacgaactaacccctgtacctacagtgtgtgatttatatgtacacccccttcgttacacagcaaccaacatcttagcgccctgcaaatctttacgcgactacctaagcgctctagttagccattttacgtcatgggttgccagaaaattttagcgctgtgcaaaactgttttctgtgaatggagcatgttgctagcaacctacacgctctagagcaacctcagcttccctgttttccgtaggttgctggcaacgtcagctttcctgattgctgctttctgtaggttgctggcaacctcagctcccctgacccccgcaggttgctggcaacctcagctttttctgatttccggagggtcgctggcgacccttagttttcctgacttctgatctctggagggttgctggcgacccttaattttcctgacttctgatctctggagggttgctggcgacccttagttttcctgacctctgatctctggtttctagagggtcgctggcgaccttgagttttcctggtctctgatttctgtagggtcgctggcgaccatgagttttcctgacccctgatctctggtttctagagggtcgctggcgaccatgagttttcctgacccctgatctctggtttctagagggtcgctggcgaccatgagttttcctgatctctgagggttgctggcaaccttagcatcctgggctatattccagctctccccagctagtgtcttgtttaaagtgctagaatatgaaggcatgattccactcgcagtgattatatccaccaaacgacgcgggcccttgtattgctgctcagctgcccaatctgtgtacggcacacctttacggagacacatcattggactatagaacgagactatctgccctgaaaactcagtccattcaatactgctgatgttctctcgtcgttcatcaagccactgatccaaaaggctaggatcctgcacaaacgatcgataaagatccccatagtctataaacagtacttcatcatcttgaaagtgtctgattctgggcattgactgggctgcgtctgtgaagttgtaaccccgtttctggtactttttgatgcctttttggatttttttactcttctttcgttgccaaagtacagccttcttgtcttttgcctggcgatagtacatatggcttgcacaccaaccaccgatgaagcattggacatgggtggcgtagaagtccttgaccatactcaaacagcttctgatgcctgagtaatagcaaccaatcatcaattggacaggttctgtcccagtagctccctgaattgttccgcgtatgatgctgaagggctgtcccaagacgtctatatagtctgctgtttctggctgtggtctgaattgatgcgggtgaagctgaaccagtattttgttgtctgaacctagggttatggtgcagctatcatagcaggagtagtttattttatagtcctggaaagcctttaggatttgttgcaatcgaggactgaaaacatccgggtattcttctagccacgaggaaagagtgtagagtacttgacatctgagcgttattgtgccactggtctccagccctcgttgagccaggcaaaagcgctggcctacctatgaacctcgttgcaagatccctggacgtgagcaggcctgtgggagtctctgtcaaatctctgatgagcataattggcgaagcgggcgacgagaccaatcaaccaacaccaaaaacatgaggattgtcacaggtctagaaggctaggaagatgaatagatttcctataggtactgtaatttggaggctgctatggtccaggccagtttcctctcctcttattcctcatcaatgcactaggtgcacataacatcgacatggaaattctcgccccagcgtacgggattgcgatcacccatggtgatcgatgaggtttctttgagcaattgccgcctgtgggcgagaagtgagtgaggccagaggatgtttcgaattgcatgttgggtattatcaccccggcactttaatgggcgttgattggtttagagatgcatttccaagcggacagggtgcaagctcagcaaacgaagccttgcatggctcagatagccattcctcgacgtcctcttctcagatgtcaccaatctcctctacctcattcccacttactcttgagtactttgcagccatggcaggggagttgacaaatttatttcgcaagaggtcccgcacaaattttaactttttttttcaactctatttcaacttaaaataagaaggtgaaaagaaagtattaaagagccaaaatagagaaatactagggaaaaaaagaaaaaaagaaagaaaataaaggggagaaaaagagaagaagacgggtagtaagtagctataaatatacgagcactagattatctttatagattccccctttgctcctgttcccgctcaatcgcttcaaaaagagacttgaaattaccagcaccaaagccctcaaagttattacgctgaatgatttcaataaaaattgttggccggtcaataagtggtttggtgaacagctgaaggaggtagccaccttcgtcataatcaatcaagatgttgagatgttcgattgtgttcagatcctcttggagctcccagctgcggttctcagttcggaggcgctctcgcaccgtgtcatagtaggatttgggaatgctgataaactcaacgccccgagtacgtaacgcagtgatgcaggaaatgatatcctcagtaaggagtgcgatatgctgaactccgggacctgaattgaaggtcacgaactcttctatttgtgacttcttcttggctggtgctggctcgttgatgggcatcttgaccttgttatttgcggatgccattacgatggagctcagtgcagaatattcagtgctgatctggttgtcgtccaccgaccagaagcggtgaaagccaaggcacttttcgtaaaaagcgcaagcctttgtcatttcgttccagtcttgattaccaacacaatgatcaattcgtaacagcggtacatgaggaagttcaagttccgacgacagctccttggtgactgcacgaaaaccaggcaagaatggcccagaatattgctggcgatttatgagcgtatgggtcgtgtcgccatacgtccggattgttgctgtgatggtgctgccaagcagcttgtctgaggttactgaaggaggttgaacagctatggccgcttcgttcatgatggcaaagttgtagatacccgcaacatcgtccacctcaaaggcaacgtccttgacggcatcgccatgtttctccaagtgatcatgcatttctcggagtagggccttgtcactcttgctgataggctcatcgtctggcaaatgtgcagcagagcgaagaggtgaagtcaaaatgaaacgaatgtcttcgtttgccacgacatatgaggcgaaataacgcgaatctgtctccagaccacgatatgcaatagctttgaaaccaaagagctgcgtatagtagacagtggcctgtttggcgttgcctacccaccaggtaacatgatcatagctggagaatccgccaggcgcctctctttcaagttgggatccatcaacctccaaagaagggatgatttggccgtgggtcataggcaccggggtctgagggatagccgaagaagccattgctaaatgatgtctacttctttctagcgggaatcgagtgtgagtaagcgttgctgactgacaaatagatgcccaatcttactgttggattatgcaaaaagagtgtgtcaggcgcttggaaaaggctttggtgttgcggccgaacgcgtacaaaagatggcaagaacaagagagacgatgaagggctttgtgttgatcagtggaactttctccttatttgatgattgtccaaggcgagatcccttttttatttggatggttctctttggcttaaaactattcggacaaggtcacaggaacacagtttccctttttatagtagctcaatgagcttttgacaggctgaaatgagtgaattagtgaatgctgagatggaggtgtctgccgtgcaggtaagcatttgtgatccctccgcccttcaagtcatttccgctgtgacgaattacaaatcaggacggccgcctcccaactcaatttgagtccctgctaactgggtagctggcacaagcgaccactccattccgcacgcacggcgacacctaaaaccacatgggacgccgtcctccatctttttagagaaggaggcttgcagatacagctggtcgggaccctgagaggccctgatgcctgaaccctgttttgtcctggcggccatgagacaagtcatctatcggccagccttaccatctcgcgagtccgtagagcgaggagggcagctcagcgggcgcccaaactctagcagtcgggagatggctttattacgctgatcgccggccgtgcaaaggaacatgtcgaatcgggtattcaccttgacgatgtagactgacatgttttagcttttttggcggggagcgggcctgcaagctcctaaagttaaaatcgatgataccatgattgagatcctatgatcgagatcctatggtatggtcgagatcagataacctaggcattgaatttggtccggcttgactacccaagtgccagcagatgatgtgttacttttccatcatcacatgagaatacacccctgcagcgaccattcaacaatcccgcaagactcaccatggcttttattgtctttctcctaatgacgcctatgaatcttttgaacaaatgctgctggctagaggaatgtctgagaaacattccaatttgtccccgctggaaatagagcacaccctgggacatggtggtcgaggccacaacaaaaagggagcgttaagagttgtgtcttagacacactcaaggacggtagaagatggtaaaaagaagacatgcatgattaggcatcgcgatgtggttttaatctcacgacatctgcaagtccattctgaattcatcttgaacgggtgactcggaaattccgcaaacatgtccaggggtagaagcacagcaacttcccatgaaaacagcatcaggagcttcatacaaggggtgacgaaaacagcacccgacttattgcagtgtctccccccggaagcggtcgttgacttgagaagaaacttttggaatattttctaaccatataaatgattagctccgcagcttgactccctagtgttctccctaacctcgtcatatttgcaacatcggctttccaaagttggcaaagttggcaaagtcgcaattgagaaagatattggcgtctggacttgctccaatcacaatcatggtcagatttgcaacacgtcatgtcctggcagcaacgctgggcgctgctgctgcggcaactatacgagaagcgcaaaatgacctcggcgctctagctgatagcttgaagtttcgaggcagcgtctacgccacctattcggcggttctgccgcgtgccatacaggcgtacgataccatatcggcgctggtaaatgacactagtctggcgccacaagcacccacgatccggagcagcctcgcccgactcatcaccgagagcagctactttgtcaccgaatcattgcagccgggctttgagcccgaccctctagaatcggacagctatctaacggctagtgtcactgaatggagctataccgtcaaggtgctcggcaacaacatcgcaacacccgtttgcgacatccgctccaacctgcctcctgcccaggcttgcaccatttcatccgacgccgcacccggcacagagtttcgggataatgctctgacgccgagaatgattgtcattcctacggggtccttcacggctggcgcaaccgacgacgaacacgtgcgctgggatattgacgagggcaagaagccattcgagataccccagcgacaggtgtccatctcaaagaaactagcattcagcgtcaccgaagttaccgtggcagagtttgatgcctttatccaagctacctgctatcagatacgcaagggggcgcgctggtggaatccccagaatgtttcccagttcgtcttcaacgacgccctgtcctaccgcaaccccggcttcccccagggccctgatcatccggtagtggccatcacgcgctacgacgcccaggcctacgcgcggtggctctcggccatcactggagccgtctaccggctgcccaacgaagatgaatgggagtgggcagcacgcggtggcacccagaccaccttcttttggggtaacgatctcccccctgctgccgagtatgccaatacgtacgacgacaccgcggcggcagtcaaccgcttccgctggccgtcgaaccacctggtcgaccctttcccctacacggctccggtagcatcgttcaagcccaacggctacggtctctacgacgtgatcggaaacgccagagagtttacggctgatgactggcaaaagaacctcagcacggcggctagggatgggtcaatccacaagggacctgcgccgtttccggtcgtgcgtggtggagcatggaactacaacccagacaacctgcgcatcaactaccggagtggctacctttccagcgaggttgctaccaacatgtttggcatccgcctagtgagagacttgtaatgcctgcccgaagcggagggcatgcatgtcttgtctcgggatacattggctgggtgtgtgggttgtggcagggtaaattttagtttagttattatttcgtcgtaataaccaaagttcactacaccatattgtgctcgagaaaagaattgagatagtaatgtgagtttttttaaaaaaaaaaaaaaaaaaaaaaaaaaaaaaaaaaggaataaaggggtgggggagcaaacccgggacagtaaaaagcaactaagtccatatccgacacttcatggtttgatgggacaaaagatcttctccaaagctcaatacaaggttcgtgggcacagccaagcagaaaaagttagcagtaagccacatcaacacccgagatagattcgtgagacatcaccgcatcctactagtgaccccacaggaagccatgctttcattcctgtgcacgtcagatatcacttttgtcccaatacactggtgatagacttcatatgatatgactttgactttttcagctctcatttccctgccacatgcacattccggaaatcgacgtttcaagctcgaggaatgaagctaacctgatgcgtgacctgtgaggcctctttctgattcaccttgtaaatcgactctctcagtcatcgccgatcagatcagattacggcccgtaggcgagcaaggaagccgcagcacaaaggatgggtcaaaagaaagctcgggggataatttacctgcttttctagcagaatcacaccatctatcagtttcattgcaccctacagatacggcgtattgcggtcgtcttgttgcaatcagaaactgtgggagcttctctttagttcatacgcgcctcgatgtcaaatcacgtcaacacagaccccgttgccagcgatgagggtaccgtgacaccgggatctcaagactcgcaagcaggcttgaaagatgctgatatctcttacagctcaagtcatgttatgcagcatcgggattcgcttttcgaggtgaccttggacgaaaatgacccaagttgcccccaaggctggtcagccttgtatcgtgcttgggtggtggggacggtgtccttctcagcctgggtagttgtcttatacagcacaagctacatgagctctgcccctggtctccagtccgagtttggggcgtcttccatggaggcaaccttgggaatgacaacttatctaatgggactcgcccttggtagcctctttagcgccccgttcagcgagatgtacgggagacgaattatttatcttggctctctgtttgtgtggaatctcctgataatcccctgcggtctggcggtttcaatgtgcgccatactggtgtcccgattttgggggtgagcggaaatttttgaacagaacatcctttttgccctggctaattgacgataacctctagtggagtctttgctgctgctctcgtgtcaaatggcccaggaagcattgtcgatgtgtcaaggccagaccagcttgctctaggcatgtcgctctatagcctaggaccattcagtgggccagtgcttggtccccttattggaggcgtcgttttcgagcacttgggacggcaatggacaagttggattgtgctcatacttggtggtttggcatttctaatgatgctcacaatccgggagacttacgtgcccgagttggtacggcgaaagacgaaacagctacgcagccaaacaacggaccaacgttggtggtgccagcatgacggcaaggagtcagctttggattcggccaaggtgaagatctgccgcccaataattttgttcttcactgaaccgacggtttggttcatcaacatctggtatggtggatcactcactcactcttcatcattctccgatgacttgccttgtttcatccgactggctgaatctaactaagctgataggaatgctgtgatatacggcatactctatctttgttttgtcgcatatccgatcgtgttctcgcaacaccgtggctggggtcccactagctcaggtatgtcttacctaggcattggcattggcatacttcttgccattgttgctgaaccattaattcgacgaatcataaactcggggcccaaggaccccgtaagcggaaagccgcagcctgaaaacattgcagccatcatggcagttggatcattacttagtcctttgggccagtttggatttgcatggacatgtttgccggcaagaatacattggattgtgccaatgctgttcggcatcccattcggtgccggcaatactcttagtttcatttattcaaacagctacctcggacgagcgtacggcatttatgcagccagcgcgcttgctagcaatgcagtgatacgcagcattttcggcgccacgttgcctttgatagcaactcgcatgtacgttgcagtatcgccccagatagccggcaccatatgtggcgtactgttgctactcatgattccgattccttttgttttctggcggtacggccctcgctttcgggagagaagtaaggttatcaggcaggttggtatatgaaatagcatcaagttaaaatatacgagtcatctaaacgctatcctcttattgatttcgatcctgatcctactgctttctgtatcacttattgcccctgaattcttttagaaaaaaaaaaaaaaagggactgagtccctggaccataaagcagtcgtgggccatacagtacaatagagctattgatgaaactatttaaccaaaaaccccttgtaaatttaatctacatgttgattccgtcgacttctactttcattgtggaaatcacttcgcaagcttccaagatgagctatccgtccaatgccaactgaatcgttacattgagtcttcttacaacgggattatataggtttgggcacggtatgattcgatactgaacaactcctcccaaaaacgaaatgccatgtatgagaatacccgacatctttagggagtatttattactctacttgaactaaactcagatatggctgttgggagctaaatactctgcaggcacttttggccatttatcaactgcgtcttgaatgatcatcgacattccaccagccatgtgattcgcgatatggcaatgcagcagccaagcaccaggatcaatggcgtgatagcgtatagcaatccacgctgggacaccatccctggctcctggcgatgtccacgtgtcccttctgggaggattgttgaaattgaacagttgaggcctctcgttggctgctgcttcgaccgatggccatctgaaaggaccggtaccacttccgagttgatggatcttattgccgtgcttgtggataggatgtggcgggaagggagtttcatttgcgacaaagatcagatcaatccattcgccgaagcgggtcgtgatagtaacgttgttgttagcctccgggtgtggattaaacaagatgggtgtctcgtcctcaaagtcttcaggcatgagtctggtagtgttcatcgcccagagatatgtcacatcatcctctatcatattaaggatgaatgtttggttcgcagcccgtgggatccgtttgggtgggatcgggaacggcgcggccgttgtctcattgaaaaacttcacgccgggcgaagctgcggccccgaccaaattgatataagggctcgcctcaaccacgtcaagagatccgcccacagagagcaacgcgtggcccgtgattatttgacctacgctcaatgcgtgaacgcggatcttgaaggctcccggttgattcgtcttgacgagaaccgagaaacggtcaccactgccgaggactaaagcttgaaccttttgtggttggacgtaaggtccatccatggcatacacccacatgtcatgtccgtcaattgagatggcacctcgaacgaggttcattgcgccaatgaggtcaatcgccacccagcgctcctctggccaaggagaatttcgggccttgatgacctctttcgctcccttggtaggattacatccggagaagataccgtcggggatggcgctttcattgactgggacattggaaccgccaaacaggttggtaaccacttttggaggcaggcagctaacagtgaagacgaggttagcaaagttgaacatcaataatgatggagctggcttaccccttgtctgttaacacggatcctggtacggtgtcaagatttgtgcgttgtattgtacccatttgctttgccaaaacatctggtcccaagcattcgacgttgcccttaccattaaaaagaagggcgtcatagcaaggaatctcaatcctggccgcgtgagtgaggtcttgtttggcggttgaggtaaggcgcgtccaatcagtaataagcaatggttggacctcacgctctgccttgatcatagcgtttaccgccttggtgtcgttggagatgagattgaatggcttcggatcgttttgcctgggatggatgacgatagcacctgtcaagccatcctcgatctgtgctcggtaatgcgcgtgataccagtaactgccctgttgcttcgcttggaacttgtaggtgaatctctctcgaggctgaatggcgcgctgagaaattcccggcacgccatcagaccaaggggtatcagacatctcgagacctatgacgataatttagagccacggttgacgaagggtcttttgatggtgcctaccgtgaaaatgaatgctgatattgtgaggggattggttctgagttcgaatgataaccaggtcatcttgatctacctcgatggtaggccctggcgaaaggttattgatcaagaacacttccctggaaatgcccactggagcatgactacccagggtaacattgaaatcgtattcctttgtaggaggtccattgtcaaacgcaatgctccctacagcccggtacagagtcaagagcaggatgagtacaagttgataacccatagctacgtagtcgaagctgtgcagggaaaggttgtctgagtatgtggcacactttcatcccaaggaccaaagaagaaatattggtcattttgtatctcatggcttagtacatttaggccctgatcctatgagcgcctaagtcgtgccaaagttggcattttggcataattttaatgctattccccttccatcgctagatttacataaaaactacagtatccataattcggcatccaatatccctgtaagcaaagtaccatactagtaggggccttaaagtggtcaaaaagtggcttagtagccaaggattcatacttattttgcttaaaatctgtgctgaattagctcttgaaaataggcatgccaacttagacatttgccagacatcatcggtgcatcagctaataccccactgggggatgtaccaatctttgtttggcatgccaacttaggcgctcataggatctgggcctaagttagtggcaggtcaaaaactggctgtactcagtgaacccgcgcgattcagagtgtaatggtaattgatagccggaaacagatcccacgtgagagatcaagtggtcatactaagtttgtaagtgcgttgtctaagccatttccaccaacaagcccagacattcatctcatttctacggagtacatgacttgggctaaagcccgtgggtttccgttttcattttaacttggctcatttttgacttatactagctcatagaaagaacaaacttaaaacatataaatcttactgagtagttgtagtctaagctcttcaaaatacacctaaatagtttttagtcatttttagctttgttcctttttttaccaatgaatgaatgaatgctcagatacccaggcactctactaccgaagggcctcgaacccatctcatattaagctaaggggcatactacaagatccttccgagtatcgcctcttaaacttcaacaggtaaaaacttgtatacctgcttgccttggtacggcggaattgtcagatactacctactgctagtcacctagcaagttgttcggggtgcagggggcttttgaaagcaagagtaccaccacatatttaggaaacaatagtcaaaaaaattttgattttgtactttccctcttcctttgtaataccaagtctcagtgcgagggtcttctcggacatttcgtcgaacagccgttgccgaggggaccgagccccggtgaggcgagtctcctaatattcttatttagtatttatatggcacaccttatccctgaatggtattcttttggctctcgtcatggtcaaaaagacatttggtgggtgtcaaggttgattgttgtgtacggtatggatgaatgtagtaaggcatgattgatgccagcatgcagatcgatgtaattgtatgcatgatgacagctttcgtagagctgcagttgaatagagcatggtagatgacgagaatcaagcccatcggatacctaatttgattcctgagacatgtagaagccttatgagacaatccgaacatagatctgagacacttaactggcgggaccgatttgtctggggttgccaagggatctagcatggcggcatctaaccgaaatcaggcaaatgtggtgcagactccagtctccatcggatgtccaaggtgcggtcttgaacggaggcatacgccgacgccgaacacttgcccttcacaacgtcatcactgtatcaattttacaagatgatttgcatgttattaatcagcggatgctttgagaagctttcttaattgaacaggaaactgggggtgccagcttggcaaatcacgaaagccaagtttatagaatggcgagactcgtcttcataatcgcttgacttggcgtaatccttgttgtttcaaaatactccagcggttcgtcgcgagtgaagatggcggtggagtcacggagataaatctcttctccatcaccaaacaatcaccgccaaattcgctccgaccgacagcctcaccaagtgactgctcaagtcattcaatatctctcatccaggaaccacagagcgttttagctcgtcgtcctcatttcagcctggtgatggcttctaccacacgcccctcgagctgcgctactcctaccgcctcctctcccgcatctccaaccaccccctcctccgcctgctcctcctcttcctccgcgtcccgcgcttcttcccctgccgcctcccgccccggccccgcgacatcatggcctaccaaccggaggcctacatgaaccagcaccacccggacgtctacgagacccgcctcatccccgcctggcgctggcgcgacaccccccagcgcgccttctaccgcctctacgagaccgtctgcgcctacgacgagcccctcacgggctacgaggccgagtacttctggcggcggagcgaccgaccatcgtggaggcccgagatgctgcgcgacccccgcgaagacggctgcgccgaccgcgagcagctcgccgtcatggcctccctcgccgacgccctcaccgacgccttcaactggcgcctcgagctgggtctacggcccgacggcgagctcgtcgagggcatatattaataaatataaattaatataacttatctaaagaagtactaatatttaatctactagttctactagtagataaagaaaaagaagaatcagggtactttagtagaattaagatctagttaataatatctatagtatctaaagattatactatactaatagtttactactcctctagtattactttctcctgaatataaatactattctgcttatctatatcttatactctataataaaataaatattataatttcttttatactacttaatactagtaataaagatataaaacctttactagtatctcttaaagagtaagtttaaaagaagctagtttattttctaaataatacttcttaataatagaatattttactatataaaaattaatagaacttagtaattaaaagaagaataatatatatactgggatactactttaatactattataaaactgatctaattttatatatttactataataagaagaagttttaattatatagtatactttcttatacttaaaataatttaaataagatatagttttaatacctatctctttaattagggatataaaatatctatactattataacttcttagataaagattataatataattaatataatatataaaataattaaaagaaggaaaatctatatactaagtaaaaactataaaaactaatcttaagaataaaactaataagagaaggataatatattataaataaagtatatactactctgaattatatagtatatcctactttttctattaattaagaatagattactataaattactaataaacctctataatctatatctaaacttactttagattactagtaagtctatataagccccttagtatatatatatatttatttcttagctagaaatactcttttagatagttattaatataattactactatctttattaaaactagctccttagtacttatacattagtagtaacttatatagtactaagataacctaattatactactcagaataatactctgattagtttaaccctgatctaccctagacctctgtccagtgtaaattacctaactgttataaaattagaagagtattagatttaaaggagaaatatatagtaatttatataattaatccctttagaaatatcagagatatataatttagataaatataataatataattttgcctaatctattgtatgaaatctaacaagttccgcggtctccgctagttctatagctcaacatgagactccatcatgcattagcgcacagcaagacggatgtacagccgccgaagtcgacaggttacgcttcgaagtggatattggtatatatccagacaggtgttacacttagtaaacagtactagatgggaggactcacatgagccggatccgtgccgaaggctgttacagaggcgctgcattaatccatggcggccccaatggtggaggcatgcctctaacaccgtaaagcctcttttcagattcatactagttgtcttagttgaattccgtcacttttcgttgagaaatgctagacatattagttatcccacacataggtacaagacccaggataaaagagaaaagttcaagtttatattggacgatcgagaacattcagtggcgttagtataggtatatatgtaaaagattcagggaacttaggcggctcaattcctataggacgatcgagaacattcggtggcgtcagtatggaatgtatataaaagattcacggaacctaggcggcttaattcctgtagaaatggtcgagaacacctcatagcgtcagcattcaatagaggcttaaagataagaaagtttacagtaaactagatatactaactaactatattcagtagacttggtgggaggaaaccgatcctcaagcccctccatgatccttactccttggtatgttccggtttctcttgccgtcactcttagggaaagttgattcacatgtctgtctggacacggtattacgcagcataaaatgcctgaaaaagaagaacgcaccttctttctctacagagatagctatccgcagaagctgagcctccggatatttccttataaaacgttgccggaagtagaggagtgaagtcgattccttgggagaaattaccggcgtctgttggattcgcggcgggtggcttctttgctttcctaaacttgtggcatgaagctcatggaccaactagcataaggtggtagtacagagtgctctgtataggaacgctcaacttggtgggttcaaggcggcaaggggacgttatttaagtactttacatgtgacagtcaggtgatagtggtaagcgatgttagtcgagtgcatgtgataagaaagcctcacacaaggaggtgatagtacaaggaggtgatactacaagtagatcatgagccgagacctatgatactcgaaggtagtatattattttcatgaaggccacccgaagtggaaaatcttatcgtttatagaataatctgctcggatctttaagaccagatgtcgaaatcgataaagaatgaaacgtattccagccctgcctatagcgtcccgctaccttatcagcagtaggtgttatagccacgccgacttacgtcctcctgtgttcagggaatgcgtgctcagaaatgttcgctgaccttccgtatcttcgatagaccaattactcatggtagcgatcaaggagctcgaggtacggagttgaatacggcaagccccaaaccccagcagatggctgcgatttctcctagacaatatcaatacccccattcaagggcaactttcccagcccaaccaggagttccaatcgtctccaatcccattcatgatccacgacggtcagttgtgcacgcggactcccaagatatggtcacttggacaactccgctcggctcactcaacaagacaacagcgctcgtgcaatgtgctgtctgcagctcgacaggtatgacagtaatcagctacacccctgggtctaccactcagtaagcctccctttcccccctcctggttcgccaaatgatgttcttgctaccagtacgcacaaaatccaaatgaggcaagagctgacgccacggtacacatagtctgtgggcaatctgcctttgcattttcacgggactatgctgcataccatactttatgacgtctttacaagatgtcgagcacagatgcggaacttgcaacactcttctagctacgtggcggaggagcggtggcgttgaactccaccaggttccgataggtgggagttttgcgatgggccgttgactatgaagaacagttggagctggtcaacaaataccgaaactggggccttgtcggtgtcgtctgcctgtcatttagctggcagaagccagaggactatccatattgttgtggttagtaatttattacagtgttgaaagaagacaaccctagtacctggaatgcgaggaatgagggggtattcaggtctgtgaaagttgttaagaatacggcaatccatttggacatagccatgcaccaaagcgtatatggctctgataagccggactagacagggatatcgtcggaagcagcatctcgcagggcagtcgtactgttagagtagcaccaggcaaacattgatttcaaaattatattcgcgtaactataatctttcatgttaagccccaatgaccaccacctgtgccctctctaagacaatctttgctcctgggccttcctcaggtattttggacaagccgccgaacaggcagaatagtatttttcctgtagatgcgctattacctgctggctcgttggcgaattcctccgcaaaatctgtccactcgctcagtaacgcccgatggggcggcttttccacaataaaagtgtctcgggacctgcgcatcatcatggcaagagagaatgctccctcacaaagcttagcgagcgaagctcgacccctttcctcatctccctggctggtcgtgagtgcgggcagcatgaaatcccagatcatgtggaaagtttccttaggcgcgtccggctcggtcttcatcagctcgacgcactttaaagtagcaagtctccaatcggccatctcctttgagtatcgcactgcgacaggtaaatcgttagcgagcttatgtacctcaatccgatatcctatatactacgagcgagcgcatacctagaagcttattccaatcttcttcgatttgagtcaagcggtgctccagcccggagtcctcacgcccaagaccaaattgcggccggctgagtaacgtctcgtccaggatgtcgaaaaccttgcccctaagacggttctcgaaatactgagagggaatacgcttcgaagcgaaaggctcgaagaagcttcgaaatttgtcagtccagtcccaagcagaggaaatccgctctccgctatatagctttctcacaaccatgtgagccaaattccggacctccataaacttggatcgcacgtcgccatccaggacgagaccgcttgggccttttgtcagaatgccgcgcaggttggcgactttctcttggagctccttaactctgcgttgctcttcgaagagtttgcgcttcatgttttgctgttcatgagtagcatttgccgccatcgacctcgcctgatcaagttccgactccgtagtagccagacggacttttaaattgtctacgtctctctctagaccagtgcctggaagaggtgtttggtctgttgcaagagcggctgcaggcccaggcccatctttactgccaaatatatgccactttcgtgcccgtaggtcgctctgttggttattcgcgcatctcagccatgggaggtggtttggggagcttacagggtgtccaccagaggagcgattagatattctctgctcctgaatgacagcacgctcgagtgacccaatgccagtttgaaattcggttttgatgatatctctaatttgttcatggtgatccgcaaggatctgacggagctcatccgacacctgtcgatcccctctccaatccatcgggtcctctcgagatactgcttcgctttccatcgcaggcagattatgtcgtccaacgttatgtgagccgtctcaaattatgtggaaataaatcccttaaaatgaccacaagaccccgtaatgagcctgtacagagatgagacacaatatggcggggaatccgctgctgtccttaaagccgataagacgcgtggtatgaacccaaatcagacggggcagtacaatcacatggcaggcgctatctcggatttctgacttgccgggactaaatgtcattttagatatgtatcgcttctctttgcttctgatttatacttggagtccagacctggtggcgctggcgtgtcggattattgagtaggaggtgtaacactacctagacttgtatttcaataaaaatgatatcatgctcatctgtgactggtttgatgtaccgggacgatgggtgggccgagagaggggtgtgtcgagagggaacatatagggtgtgtgcttcttgtagtggtgtcgttcaagcggcacctctcacctacggctgctattaaaccaacatgccatcattttatatgctaattcttaaagtttgtgccaacgaggttaaaaatccaggtaatcgacaggagggtgggttaacagagagtggcgggtgccgcaggcaacggcgccgaggcttcgttataaacacattctggccggccatcaatcccttcaattacgagctggaatttcctcatttcacatgacttgtaatctgaattcaattccctcacttttaccaagatagtctatatcctatctctatagcgtgagcaatgactgatgcgctcgctaaagacatggcgagcctaatgggcagcgccgcgcctaaagtgctggaggctgaggaccgggtcgttatttctctcgattttggaacaactttttctggaattgcctatgctttctgtaatccaggaaagaagccagaggttaccaccatcctgcaatggccgggtaagaatgtcatgacacatcacaaccctccattcccttagactcgcgcatctacgctaatatgccctctttctctaggactcgaagggcgcacacagccgaagataccgtctataatatcttacaattcagatgatcacaaacagttcagatggggaggccagctgggttggagagacgactgcgttcacggcgtgaagctgcttctcgatccagaccaaccagagcctttatatctcccaacaggccataagaaaaaggagatcaaaaagctgcctaaggaccctgttgaagttgcaggggacttcattggagccatctatacgcacgccatggctaagatagaggctacagtcccaaaggactactttcttctttgccagaagcagtttgtcttgactgtgccagctgtatggtcagacaaagcaaaagacatgacacttcgcgttagtctctcttgattctgcggaataaggcggtccaacagctgatgtattgccaggcggcaaagaaagccgggatccatcccgtgagcctgataaaggaaccggaagcggccgcattgtacaccatgtactgccaggaaagggcactagaagtacgttggtattgcccttgttcggtaatgcttggacgtttaccttactaatccagattggtgatgcgttcgttttgtgtgacgcaggtggcggaacagtagatctgatcacgtacgaggtagttgcgacgacgccgagtctggaactggccgaagttgttccagggtctggtcagtaaatcctaaatctccaaataatgacaactaacagcaaggcgggaataggcggcatggctggctctcttggtctgaacaagaggtttgccgaggcggtccaggacctggtcggagaggaggaatggataaaactgaaaaagagcaaaggatgggcaaaagcgtacgacgagtttgaccaatatgtcaagcggcgttttctcggtgatattgaggaagagttcttcatgaacttccctcaagctagcctggaggacaatccgtccgaagggctgaaaaacgattgctgggctatgactgggtgagttgcgccatttaaccccgcagtacggaagagactgactctagcgaaaatgaagagcaatagtgaaacaaatcttcgaccctcttataaccgacatccttcgcctcgttgacgagcagatcaagaatgcccttataaaaagacagggccgggggatcaaagtgaggaccagttgcacatctcatgaaactgtctctgacacatccagggaatattccttgtcggcggcttcggtgctagccagtatctcaaggaatgcatgcaaaatgcagtccctgatgtccaggtagtcaacttcaatgattcttggcggtgctcaagttcacatcctgtgtcaggttatacagcccgatgatgcttgggccgcaatcctcaagtgggagaacacgctctttgggctctgattctgacttcggctaatccatgcataggggcgccgtactgagccgactgccacatcaggcagttgtggtctcgacacaggcgacacaacactacggagtatctgccttgtccatttacgagcccgctatcgacaaagggcggccgatcgaggtccatccgtctgatggagtgaagcggactgagagggtgagaggaattagttccgagatgctacgttgaaaacagctgacgaacatagatgacgtggtatatatatcgtggcgaggagctgaagagagaccagaccataaagttcccattttaccggacactcgatgcgaacttcaaagacgatgacctcatcttctcggacaagctaatcacatcaaactcgccattgccgccgaatcatccaactcaggaaactaaagagaactgcaccctaaaggcggacttacggaatgtagataggtctctctttatacagaggaccggcgttaatagcctcgtttattatgacgtgcactatgatcttgctgtctcgacgcaagccgccaacatgaaattttggttggaattcaggggggaacaagcaggatttgttgatgcaacctataattaaacgtccgtgccagtgatagggataatagtagggcttagtagctagttatatcagagagtttcataccgaattaagatcctaaatatgactggctaggcggcaatgttaaggcagtcctcatatggtgaatataggcttggattacgcagtgaccagtacagtattcaaagcaatcaattcaatcacggccagagaactaataaagaaggtgctacacatatacagcagatactattagaaccgaggtattatataatctaatgtacttagttatattaagactggtttaatataaatatatcttttttcttaaattagaagagtattaggcttaaaggagaagtatatagtaatttatataattaattcctctagaagtactagagatatataatataactgaatataactatataattctatttaatctactatataaaatctaataattaagagtttttataatagttagataacttatactgaacagagatctagagtaagttggagttaaactaattagatattattctgagtagtataatcaggttattataagctatataatataagttactattaatatataagtattagaaagctagtaataatagatatatagataattatactaataactactaaaagagtattcctatcttataaaataagtatatatatatactaaatagcttatataagcttactagtaatctaaagtaagtctaaccttagattatataagcttattagtaatctaagataatctattcttaattagtagtaaaaagtagaatataatatataataccaggggtatttctttatttataatatattacttccttcctattagttttattctaagactaagttttataatctagtatttagtaaataatttctttttcttttaattattccctttatattattaactatattataatttatatctaaaaaatcttattaatataaaattcttatattattaattaagaaaactaggattaaaataatatcttatttaaattactttaagtataagaagatatattatataattaagatatctttatattataataaatatatctatattagctagttctataataatattaaaatagtattataatatagagtttcttttattatatagtataaataactatatataaataggtattaggttaatattaaatctatattattcctatacttactagattaagagcttattttatatatagtatatatagtaactatattttaaaatataatctttcttaagaatattttaatagatatagtatagaaagtattaaagagaatctaactaaatatttattttagattactagactatattatatataatataggaatctaatttactaataattaattttatataaatactagaattataagttctaagtataaataaattctaattaaggtttattagttaattagtaagattaaaagatattataaactattataatatatatttaatattctatataaggaacttaaagagataatattaaaggaagctatattataaatagtagtaaaagtagttaataatataatagagcctaatagctttatactaatattacttatatttagagtatatctaagagttattactttcttatcttttttataatttataatttaaaaagtataagtagctaactttataataaaagtactaagggaactatatactaaagagagaactatacttatactagctatatataatagcctaaatataatagaacttcttaaatttctacttctaaataagattataatatagagagagaataagaagtagtttaaactatataagctattattaaataactcttataatattataattaaaatatataataaattaaagaccttttagtctatatagactaaaactatattataaagataaatagatagaaaacctagtttaagatagtattaatctaagtaaatatctaaaagatcttttactacttataataaataagctactatagagaaagaaataactaagaggcttaaagaatacgctaaaagtatatatataatatatagtataactagttaaactatatactaactatataatatataaagaatagaaagcccttaagctagctaaaaaactataaaagaaaagagttattataactctaggtactccctttaaaatatctataaaagtagaaattaaataacttattaaaactagagtttttaagtttatatactttagctagaaggtttaaagcagctagctatttaaagtatatattattaataagataaagagttagaatataaaactatataagaagagctatttagttttataagactataataacttagataaagagatagttcttatatagttattaactatttaatactatagctaatatcttattcttatattagtactacttttaatataagtagaaaactatattctaactagtagagatattatatagatctatctatagtctaagatagatttataatatataatatatataaaactatttaaattatttaaataaagctatctagagggaatagttataagaattataaagctactatatagaatagctaaattagatatatattagtatactatatattataagtactttataatatatataaagataataatctctagttataatctatatcttctgattatagaaagtaatatacttagctttagatttattagaatataatagttagataacttatactaaacagaggtttaaaataaattagggttaaactaattaaagtattattctaagtagtataattagattattataaactatataatataagttactattaatatataagtattataaagctagtaataatagatatataaataattatattaataactatctaaaaaaatatttctatctaagaaataaatatatatttataataagattattatttatctattacttatctattactctatgttatgcttcaaatgactgttagggtccttgaagtataatctcttgttattaagctatttaggttatctaggcagctgcgatccagctgatatacagctgctaggctgcttacctaagcagggttcggccaacagctggctgatccctgccaggacccttttgaccacaacaagtgccgcctttcaagagaaaaaagccactgccccagtggccggaccggctcttcatccgaagacgaagcagctgtccgagaaggaaggaaaataaagacaggcaggcctgctaggcctgatacagatgtccaaaagagataaaaagggaagacaggcaggccggctaggcctgataaagctgtccaaaagagaagggaagagaagacaggcaggtcagtcagacctgacgaaggtgtccgagagagaaggaatttacagacaagcaggtcatacgaacacgaagagggtatccgacgaggcagaggttcgaagacaggctcttcgcacgggcgcgatacagctgtctgacgaagaagaaggttacggacaggctcttcgtacgagagcgatatagctgtccgacgaagaagaaggttacggacaggacttatatattaatagtaacttatattatatagcttataataacctgattatactactcagaataatattctaattagtttagctctaatctaccctagactcctgtctagtataagttatctaactattatactgcttagcttatataagagctaaagctattagagttatatctagaaaacctataaaagacctagtctctgtactagatataatagagggagatatagttaaaataaaacctataccctataataaaaagccttataatctctttctagttaatagaaaaactagatactactaggctattagtttagctaataaagaagctataactattagcctagctattaagaatctatttaaaggctttaaaaattaatataatagatattctaagaagttttattttgatagaggcttagaagttaattttaaactaagagattagctagataataaaaagatagcttttttaacctctaacccttatatttatagttaaaatagacttatagaaaggtctattagactaatcctagaaagattaagagtttttattttataggctaatatttctatatatctctagtattttattataaaagctatagtaaagctagttaatttaactgctatctctaataaagagttaataccctataagttattttataaggaattagaaccttctagaaaccctaagcctaatctaggcttttataaagctataggtagctattataaagctataatccctttagaaaatagggaaaaatcctataagctaaaacctagaactaaactagctagactattagctatattaagttctaattcttatctaatttggatatctaagagaaaactagtaactaaaactagctatataaggttcctagagagtattagttctttagataaaggtttttagaatatagaaattatatctttttcttctgaaaataaagaacttataaatccctctcttctaaatacccctttagagggagaaatagaagaattaaataattctagagattctgatatattagaatttttagagggagaaaaaaagataattttagaagagcctattataaaagttcctttagaaacctctaattcccctataacttctaaacctttagagggagaatctatagaaatagatcctaaggaacttctatactatagctataatataagctataaggttaagaagaaaatactagataaggaacctttttcttttaaataggctataaagtctaataataagaaagagtagttagaagctatatttaataaactagaataactagtctataagaactgctttttctttataaataaaactaatatacctaaggatagaaaaatcctattaaataagttagtcttaaaatttaaaaggaattctaataatatcccttataaatttaaagctaagctagttactaaaggttttatataatagaaagcttagattttaaagagatttttacctctatagctattcctttaacttagtgaattttactagctatagctaaccagtttaacttagaagttaaataggttgactttataggtacttttttaaatagctccttaaaagaaattatatttataactatatctgagggttttttagagcttcttaaagctagaccctatctagttagttatataactaaactaggttataatcctgataaagaataggttatatagttaaataaagccctatatagtttaaaataaagtcttagagagtagtaagagtctctaaaagctctttttaaaactctaggattttatctcttaatttctaacccggctgtttattataataaggtttaaaaaatctatataataacctatattaataactgcttaataattaggcctagcttactagctataaataagttaaaaaggtagctaaataaagcctataagctagaagataaagaacctacttccttcttcttaggaatctaaattataagggatagaaaatataaaactttaaagttatcttagtcttagtttatagaaaaggctttagaaacttttagtcttttagattctaaacctaacttagtttctttatagtctaatattctaaaataatctctatctaaaaaactaggctataaggaaataaagttatattaagctataataggtatcttaatatatcttatacttataactagatctgatttaggatttcctatatagtagttattttcttagctagggtatctttatatagaatatcttaattaagctaaaggaatcttaaaatacttaaaaggttttaaattactagctataacttataaagctactaaggaattttattctatagcttatagtaatagtaattttactagggataaatcttctaagttaatctttagttatcttattactttaggaaatacccctattagttagaagttaaagaaggctttaactatagctttattaactacagaggctaaaatagatactttagtagagactattagagagattttatagctaaaaaccttatataaggaactaaaaagacttatatcctctataaacctctattataataatacaggctctatttctaactcctctaatcctaatctttatagttgaactaaatatatactattaaagtttaactatataagggaaataataaagctagaaaatataaaggttatctatcttaatactaaagagatacctatagatagattaactaaacctctagcttctatagcttttaaaagctatataaagcttctaggtttatcctagaagttactctcttaagataacccttataggggttaaatagagactaaaaagtctctattaactaggttttattatagttactgttttcctagctttctagaagtattcttctgaatacttcttaatatatctagaaattataggcctactctatattaagttagtggattataatccttaaaaaatatactatttagtatatattttttcggatttttatctctataaataagtatagaatatcccttttttagagggagtattgaatttgagagattatagctactataagttagtggggtcagatcgctgttagtgatcctgactactagcctctagcgattacagctactggctataatcgctaataaccccctgctaacgctagctaatagcgattaagatcactatctaatagtaattatgatcactaactaatagcagctgcagctactgtgggtcagtagctatagcccgctataaccgctacggcttagcaggccctaggaaccctcaggggtccgggctactagcagagctattattaggttatcaggcttatctagcccagataagggtctagaaaatccggaaaaaatcctaggatattcttaaataatctaatctatatccagactaccctataaccagcttaccctagactagatcttagatcttagataattcctttagctttaaagataagatatctaatatctatacttaactaatcagcttaagagtctctttcagataaaagtagatcttataaaagctatatatatcagttaaaggttttagtagttataagttaattttttagatttcctatagtaataaattttatagaaaattaaaagtaatctaagaaatagctttagtaggttttagagtagtttttagttagtagatctataagagaaattagtataattttctaatctctcttataaaaataagattcttttatactatattttatactatatttagtccctctaatactaaaacttactaagtaatagcagagttagcagttaagaattataagttatagtgaatttccctgctgtattatagcagttttaaggcctaatataccttgaaggctactgtaattttaataaaaggtttagatataaactactaattatattcttaaaaaatatatattagattatattattatctgatcttagaatatatctttatttatagtaaaactaatagaaaaaaaaagaaaactttttaataattctattctatttaattcttttctatctaataatattaactaaagtaaatatttatttaatttagaaaactattttaatctaatttaatttaatttaatatattatttactagaactatatatagtatattagattataatagtatttatatactaaaaaaatattattatagttatttataaatatattatatattagatttatttatatatctttatattaattaattactaaataaaataatagttctagtaaatataattactagatctaaagagtaattttagctagagctacccttaattatattcagatagggtctttatatctattttatataggcccctaaacctattaaataatactcttaatatctacttaaagctatctctctacatcctatctgctctgctgcaagcctattattaccaaagtcacaaaatcaccacagaatcaccacactttattttatctctatcgtcatgagtactgctcagattcaaagcctacgtataccaccacttgcgcggggagggtggtaatgaccgttctgttcttgttttaagcactcgtgacgacggccccaccagcctctattctcgcgaacattggaggatcatgtatatgcattagttaccaagagggatggcacaaagacatggaagggagggcggatcataaaagttcgccggggtctttacaaactgaaacctggatatatagtcatgacgccccggtgccacacagaacagacaggcttggtccccttgtcgccccaaaggacaagcccatcctcaactatgtcaatcttcggcgacctgcatgcactcatggtccatctgatggttgacacatttacgaacgttcgaagacggcagaactcttcaagtctcatatattcaattccatcatatatggtcctgagacagaatttcatcttatgtgatatttacgactttccattcgtttgcggctcaggtaaggcctcaataatcttcatcatgtcatgatcctccatagccgcagaatatctctcgcacatggcgaagacacgctctttgcgttgcagttcaaaaggagtgaggcaccagctattacttgtcagtttgcttcctgcaggtaataatttgaatcgaacaagcaattggaacctacccaataccagacatggcatttttcttgtactcggtcacgacttcctcgtccttgatcgagagcttgggtccgccgaagcgagcaacagcctcaaggtagtgctcaagtatctcaaactcatgcttccgtcgctcctcgaccggcaacgcacccagaatgaaatacgcaacgtcgtggaaaacagagccgagctggacggtctgccagtccaggaaccgcggcttgccgtcgctagtgatccatgtgttaccgcagtgaggatcactgtgcgtcacggcgaggaacttggggttatgagtcttgaggtgcttgctcagcgcagcctggagacgcttctggtcacggatgctctcagggaagggcgggcggttttccccaacgatcatgtcccagttctcggtaagcgacatgatgacgaagtcataagcagactggagcctagaataatcagcgtcgtcggtggttgcgccccaggtggaagcgtggagaccggccagctcgacaactccctgcttgaccatgtcgactgaccaggcttcagtcggctcgccaaaagtgttttccgggctaagatcctccatgatggagatggcctggccctgctctgtgttcatggcggcccaccacacctttacgagggcgacatttgacagcctcggggcaacaatgttgaagaagttgatctcgttcatgtacgccattctgagggcctctttgtaaccctccatgtttaccatctccgggttgaagcctgccgtatcattagcaaaacgcatagccaggggggcgagcttgccgtggggataccgtacctcccttgaggcaaacgtgctcagggcggtcgttgccagccgggccatcttcgtatgtgagagtgacgtagaccttggatgcagtttggttaaggatggtctttgtgatctcgctagacttgatgggaagcttcaggacgctggaaagccactcagtagtgacctcctcaggtactgagggaagcttgcttgtggtagtagtctctggcattgttgtaaatctaagataatgatggcgggggtattcctacagatcatcgaaaggaaaaggagacagaatccgagcttttaagagagattagatcagcggtaatggccatgaggaatggggaggagcttgctgatatccatgtgaaatgtccagcggatggatatatcgcatacttgctataggtacatgcatccccaagctctggcggtgaacaaggaccctgcacaaatcaatatgcagtttggagctaaaaccaacggaactctatccgcataacgagtctccataaacggcgggagccacagggatacgttttggagggggcgaaccttccctttctcaaacagtcccgtccttggcatggccctacttgtgcctggctctagctaggcgcaggctgttacccttttcacggccctgtatgtgaattttcagcatcgtatttcttgctattagtcgaggtattgcgaaaggaggggatttcggccagcgtgacgatggccacttcttctggcaacaccgacgaagcggtgtttcaagatttacccgagcatgctctatatttgaatcttttgcactatctttttgatgggctaccccctacatggagaagggttacttgtaggctctggagtgccagccttgtcaggttattggcagcacgggtacggaaatggctatggataagccccatcaaacggcgacctgagccggcggctacctagaagggaatcagccgagcatgttttccgagttttgtaataatgtgcagaagtcgaagagaggctggaccaacttcaatctctaaaactagtactctgtcgaaccgtttgctagtggaacaatccgcaacgagggcctaccaaagtgaatcagtcctggattcatcttttttgaagcagctagaacttcagtatgtgccttacaagggattgactggcgtgttagggctctgttaagagatgcttagccctccggctatttgctccctgagctagaggtattgtagatctgtaccctacttagatggactttgccactgtcatagattcattcaaaattccatggcttgtagatcccccaggtcaattaagaattcataagtggagaagatacatcactgaagtcctaactgcaaagagactgctgccatcaagccaagatagctagggctgggattgcggctctaacagctccaagtcggaccatctggctctgaacaagttatccattagctgaccagcgtctaccatgcgagcaccatggataaaggccggctacaatccgcgcgccacgacgggaacgcagtagccctttacatatcagtatgtggccaacatcccggaagaaagtgtcctgagttttcttccctcctggtgcgaacttcccaccttggccgaatgagggcgagtgtccacaatcaacaaggatcacaagcctcgtgtcagaagttcaccattgcctccactcccatccactttcctgtggagctaggagccttggctggatgattcttcgccttggtatatatctgccaatgatcagcccagaatcgtgcaagattaggagtttcaccaccaggaccaggtctgcaagtcttcaagccgggatctttgtcgtgtatgtagaaatcaatcataccccttgatcttgacaagagatctaagttagtaaaaaggggcatccgcttttattcgtctctttgccttgaaattatccatttgaattctccgttctttttctctgtttgtttgtggatagcaccgcgtaccagttctgccaactgccccaaaacgtgacaatggccgaggcccgagaagtgctctggcccattgggattaccttcctcatactcaacatcctcggggtcgggcttcgattctgggcaaggcagactaagaaggctttcggttacgatgacgccgcactggcgctctcgttggtaagcccaatggttcctaggcgatcatgagccagtttacttaccacgcgttccaggtcggattcattgtgtttgttgcaatggaatttgctgctctccactatggtatcggagcgcctgctgaagaggtgaagccgtatcataatccgataagtgcggcaaaggttggcaaaactgttcaaccactatctatctgacggctgactccaaacgcagtactatacgattgccgcgattgtttatattttgacgactggggtttcaaaagtcggtgttggcttggttcttcaccgcttgtcctcaggggctgatatgagggcgatccaaatcgtcctcgttgtagcgatgagtgtcatgggaattgttgcgttggtcattgctatcatctttggcctccagtgtcggcctttgagcgcagcctggggcgagtccgtgggcacctgcattgcgccgatgataatcggacagtcggcgattgtcttgtctgcatttgatgtggctgttagttggctttttgcggtacgttgattgccaaacagacaaacgatggctgaaacttgaaaatggctgacatcctacagttgctccctgtcttcatgcttcggaaggcccagttgaggtggaaggtcaagataaccatcatagttgtccttggcttgggtgcagtgttagttgaggaaactaaacgaggctgagctatcactaacagacttgcaggtcctccgtcgctaccatcgtccgactcaagtacgctgtccaagcggctgacctcaccggcaaaggcggcggcattgcaggcgaacagcttctccaaatcacactcgaggcaaccatcttctccatgaccgagatcgggctgagcatcttcgccgccactctcacggccctccgacccctcatcaagcgcctgccattcctaagcgacttcagcagcgacggacgaacaccttccaagggccagtctgggtcccgtcccatcgctagttcgaaccacattcgagggcccagctaccgcctcgacgacatccccccgtccgacggagacagcgaagaaaatatcattgcgcctcgcgtcatgaatatcaaaaagagctcccacgtcgaggtaaactaccagaggggtccgaaccactcgacgacaagcgacttctacgcgaaggaaacccaaacaaagcttggatgggaccgccagcattaacgcgtcaggcatttgtatgaaacgccgacatacttgtgactatagaatattctcctgtaaaagaatcgacataataatagacttattttcagcccaccgagagatacgccaacggatattgaaagattacaacactgccggagattctcgaagagaggactggtagcaactgtactgaatcgaaattaacctccactcaagcaccagaaccctttataacggcaaagcagttttgacacctcaatcaagacgtgattctcagtcttctcgcatcacactgggaccacctaaccctcaatggccttttcggtgccactctaaaggatactttgatttatcattgcgtcaaacctacatatactgacacgcaccatttccgaggagacaaagtaatgctcatatggaatcaattttgcaacactgacgctgaagctacaccacctctccaaccagttgccttctacaacaaacaccatggccgcgcaataccagcagcttcgcaaattcatccaagcactgcgaatatgggtacatttcaaaggcaataggaagttttatcacttacttgataccttcccctaactcttaattccccaaggggcagtagaatgggggccaaatggagcataacctaggcaatattgtacactaataataaggtcaattgacaaatttagaatacagagaagaagcagagaaggacattcagttggtgaacctatgcacaaagttcacctgggcgtgcaagcttcactcccctacttcagaaatcgcaaaatggcccagtcagcttaaaaagtaacagtttagtggacctgttgagtttgttagatgggccctaagaacaaggatgtcagttaccatttccttgtttctacagtaagatctgaactcataagtatatattactaatacttgtactatttttactaaaggatattaaatacaggctaaaacacggctttctcttatcttctttaaatgaaatcgagtttaagtataactagctacctctaggctctttatcttttagctagatcttagtaagttcaactaccccctttcagcccaccctatacttagccacagaaaaagagttttatttaattatactaatatttacttaaataaactctataaaaatttgaatagttatatagagcttattatagtaagataaatataataaatatttagtatacttcttatagtattaagcagtctttagttattcagttatttagagctttagctccttattagcagtatacagcatctagatatagatattaggctgcacgttatcacatggcaaattcctgtaggccaaaaacatttcggagcactttgactctaacgcaatagcgcctaggtatgtatgtatgtatccgcaatggggagtccggagtccggattcctaggcaaagggtccgcttcgcttaggaagcccgcgggaagcgtttgcagggtaataatacatcccggacttggggccttctttacccctttctggctgcactacctgcaaacaacaaattgtcatcttgtttgcgtagatcggatctgcttgttacctgcaatggtagataaccctgatgtctcaagtcgctcaaggcctgcgctgcgtcctcgcaaggcgcggtccaaaacgggctgtctatgttgccgcctgcggaagaagaaatgtgatgagaaacgtcccacctgctccggctgcaccaagctggagctcatttgcatgtggcccgacccgaaggaatttgcatggaggattcgactgggcttgacttcccaaacttcaagcaggagagctcccaccacgacctcgagtcctacagagcagccgtcgagccctgcccgatctgctggggccaccacatcaccactagtatcacctaagccgccgtctccatcacctccgttgtctgtattcaatctggacaatgattcttcgtcctggaaccttctacagctttacaccgagaagacagccagcctctttctgagccccccggaggacttttgcgacccttttctattcgacgtcatccccatggcttttggggatccgctggtcatggatgccgtactatccatgggagggttccccttgacaacaaatgagagaattgatagtattgagagtcaaagaatgcatcactatggtaaagctctcaaaggcctgaagctctcgttgactagctggaacgagaagcgctccgaggatccgctacgccttcttttaacaacagtctttctttgccagtacgaggtaagtgttgcctccagatcgcttatatcgccactaccttgctgtgattcatcatcgagttcaactgtgccagtagtaatgcactctcgtcactgaggctaatgtatatgcagatccttcgtggcaatacacagggtgtccgtggctaccatctcgccgcctgccgacatttcgcacaggcagtctacatatcaaatacgacagtgacaacccaaagtctggcgcatgtattgctagaaatgtacgtgtacatggagttgtcgtctagcctgcacctatcgcccaactctgattccatgcaagaggcatcagaatcagcccttgaatctctattcgggctccgcctgtttccacatttcggcaccctgctcgggagctccgctcaactctacgagatgatcccaaaaatccggagattggcgagtgatagagccaaggagctgtctctggggatagactgcggatgtgcgacgatctttaatgtgcttcatgaacaattagtcgcgtttgactggggcaccgcgctcgagactggtcccgcgtcacaaatggaagcctatctttgtggcaaggccgctgcggggaagctcgttcagaaagcgctggtattgtttctgctatcggcgtactctcccaacgatcctgcaccagtgcgagtcatggcaagccctctggtagacagcgcattggaggcagcgaggatcatctccacatcaccgtggcgaaatccggtattctggcctactgtggtcatcgcgtcttatgcatgcaccgatcagcagagggaaaaggtcttggagcttatgtggcctagaatcgctctaatatcaagggcacgagaggctctgcagtggctttgggagtctcccgacaatctctatggcctcgacggtctggcgacagttttcaaggaccatgatgcaaactattgttttggataatctgagcttagttgatacttaattcaaaatatgtggctaagccccaggtatcaattcctttatacgctcttgcttagcggctactgtactgcgcaatgtttaaaggaacctgacacgcaacacattacgacatagaataacggtgaaatagaaatgagaaattgactagaagccttgtttcaaggactatagtgtatgcttattaataagaatagggcaactattctaccttttcacgctacattttgtgactagggggggctcaatgacttaatagggcctttgaggtaccagccagcccctctctggtgttgaaacatgccgctgggatcatacttggcactgacggccttgagaaaccgcttggcttcgtctccgtagccagaatacacatcctggtaaagattggcatagttgagatagatatactcatggtgtaagcccagttctctggccaacccctgggtcttctccgcggtaacccgttgtgcattccacactcgtgggtcgtcttctgccttcatccagtatagctccatcaagaagagcaaaaagggctccttgctagcgataccaagggcattgccgccgttcctcttcatggcatccacgaccgagcgtggcacaaaattgatatcagcaagagccgacctatcaaggccctcaatatcgagaagtggtgtgaccttggtacgccaagtatccataaagaatctaataatccgcttgtcgacctgtgtgcaaaaagtccaatagccgttgtatgagcctggcggataatggtcgttgatgccgtctgtccgctgcagctggctcgtaggtcctgtctcgttcaggagggtgggtatatctagaaacctcttgaggaccgaatccggttccggcggggtgggcttgagatgttcaagatcgcagtaccatacccactgaccctcgtgtgcaataacgccgaagatgacctggttgcggaggttatccctgccgtactccaaaaaggcgtctatgagggcatccccgtgttcccaagcccagctcacgccgccaccccacatgccttcgtataggtagactttgagatccagatttgtgacaacgccaaagtttgcgccgccgccacgaagtgctttgtataggtcgggatgggagttgatgttggcttgcacaatgcttccgtcggcgagggcgacctcgaaagacagcacattgtccagtgcctagccatgtcgattcgataagaacgatataccccctatagagctgttagaaaggcgccatgggatgatcgacgagaagaactacagtcacataccagatacacaaaatcccccaactccgactgtcgaggctcgaccaccaattacggtatgtccttgaggattcaggagggcgtacacctttgcccacgtattaccagggccgacagtacaggagctcttgtcttcggacaggcgcggattatccaatcgcttcaaatcaataagaacaccgttagatatagaggattctccctcgcatctaccgtgcccaccacttttgattctgaacgggcaaacagacgtacacaggatctgaagtgcttttgctacatcgtgagaggttttgggttacaagatgcaatacggcgaacaccgttgttgctccgcagcccagaagcctcgtcgggcctcttcatagtcggcggtgtttggtaagagtgtgatggacggtaactcggactttagagtctcgacctaggacaagtcatgtcagcaaagtgaaccctttagctacgttacagagaggctgcgcagtaccgtttgcacatgagtctgtgagggagctgccatggcgttcgtggatgcgtagcacgtctaactgacgtagaagccttttctaattaggagcttggacatttatattgaaaacctgaatgttaccacaatgtactggattgtaggatctctaaaattggaaggcttgcttgcaattgatacagtttagaaattacgggctatttgaactactcgtacgtatatcaccgaccttgaaacaacgcagcaagtccatttagacaacccgtggaataccacaagggtcttaccttgcctacctaaggtatggccgcggatcccgcaacgagtacgaggtcatgtaccaggtctgctctttgggtgtgtggggaatgagaattcaacgggcaagacaggcaagacggggcaattgatgtttccggctcttatctaggcgcctttatctaagcgcagtttacattctccacatctgacccagttcgttttgtcttggccacatccttcggtccaacaacggcctcgacctctcttgatgagtttaatctaagcgcttgccagcaaacccttgatcaggcctgagatacgtacaaggacatctaagcgaatccggtgattggtagactaagtgcggggattctggggtagatcgaaaagcgacacaaatcgtcacctgagttacattcagctggcaacctgttcgagtcgggaaagaccaacatgtcactccaagctatcgtaagtattaagagatatggaagcaggcaacctatcctagattagattcaatcaagtcaagtttgagccagcgcgttcagagtcgttgaattgtgccgtgagcccttctttcccagcacattaaaacttcattccatcagttttattattgcgaccgaaatacaaactagcattagagttacccacaccataatgtcaaatctcgaagataaggctgctgatattaaaagcgacgctgcgctcgaacgcgctcctaccgagcatgatggcaccatctttgaagagagggaactggaccaagaccgcttcagcgtatggagcgttgttggcatccagtactcctgttcagcagctcctctggccatttgctcgttcacttacctggtcgcgggtgttggcggaagttcttacttcacttggtgctacttggttactgttgttggacagctcctcgtaactgctagcttggccgagatctcggccatcctcccgcatgcctctggtaggtacatttccatctatttccatcgtcccattatgggatcagacgtattaaatatcaattctagggcaggtattttgggcgggaagtttggggcccccaaagctcgctcggttcgcgagttattgagtaggggctttgaccttcttcggatggacgcttggcgtggctggtacctgtgtctttactggtgaatacattgctgcctttgccaatctcgtcgtgccgaactatctcgccaagagctaccatgttttcctcatctcgacggcaaacgcggttcttgccatcgtcatcaacgtcttggcggtaaagctactacacggcctcaacaagaccatgatcgtgttgttcaatgccgccgcgttctacatctttatcgtcttgctggttaaagctcaacctaaagtctcagcttatgatgccttggtcaaggtagttaatgagactggatggagttctgacggctttgtgttcctatgtggattcctccctggcctcctgaccgtgtgtctccctgacgcctcggcacacttggcagaggagatcccacagcctcagagaaatgtgcccatcgtgatgtttttcacagcctgcttgaacgcaattactggattcgtcatggttatcgctcttgcttctgcactgtggccccggagaatctcatggagcctctggcaggtgtgccgatattgcaaattgccaaagatacgtgggacaatcacggctgggtcatcacagtagcaatcattatgcttcttgtcccattaaatggggcaatcgccatcactaccggaggatcacgcctgctttgggcgtttgccaagtgtggcggcatcctgggaggcagaagactcggaaacaccaacgtcaagcttcaggttccggccaacgctgtctgcgcgactgcgatcctggctctgctgctttcgcttttgctttttggtccgaccacggtactaaatggcatctttggaagcttgggtatctgcatggcagtgtcatatttcctgccgatcttgttcatgttgctgacagatcgtaaaactttcgacgaaagacgccatttcaatttcggtaaatggggccgcctcatcaacatagcagcacttgtttggctcgtcgtcactgtggtgtctctttctctcccgctttacagtcctgttacgatgggcaatatgaactgggctggagttgtctttcttgggttggtcgttcttctgatgggcaattgggtaaccgtgaaggattcctatactatcccaaagcctttgtgcttagccgtgtctcgcggataagtgtagctcagctcgtcctggacacaaaaaacccatttgaataaaccataagctacgggaatacacaagaaaagagtacttacattagctaccttaatcttgaggaggtcaaaacaactagttcgtctgtaaatagtaaatagtttgacttcgcttagggggaaatagagtaagatcacaaccatatagacagcgaaggctcgaaatataggccacgtatatgcaagttcagtatcgctgacagctcttgtcgtacagtcccaaattcaaaccggacaataaatcactaccaactaatgcgtatagattcggattttgtattcaagctagttgtcgtagtatagaccatgcctctcagtaacatgctgaagtgactatacctcctgagtgtccaacaaatccttcagagcttgctcgataatatcgactcccttccacagatcttcctctgatatagtcaaaggtggggcgactcttaatttgttctgggcagcgacggcgatgacgcctcgcttcatcaccaacgcgctcagacgctgcgctgtgacacggccgaatgagtgcgattcatcaaaatgaagtccacagaacagtccctttccagtcaccttgaggtccgtatgtggagacgtgattgaactcaggcgcttcatcagttcagcaccaagcctttgcgacctctccgggaggttctctgacagtgtcacatcaatggcagcgatggcaacagcactggccaaagggttggctgcatacgtcgagctgtgtctacaggatgaatggtcagtttcgaaaacctctagtagtatttgttggaaacacctactgcccagctttgatttgcgtcatgacggttttgttgcccaaaaccagactcattggatattgccctcccgtaagcgctttcccaacgatgaccaagtcgggcttgaggttgtcatgctggaatgccatcaacgcgccggttcgaccaaaaccggtctgaatctcatcagcgatgaagaggacgttgtgcttggagcaaagatcttggacagcttgcaggtacccaggctctgctggtaagcaaccaccagctccctgcacacattcgataaggacggcggccaattcgtcaccgctggatgagaaggccttttccatgtcatctatctcattgaagcggactggaaagccggtgacatcggggccaacgttgggtaggaacggctcaaagcttgaatttgacacgtcagagatcaatcattcatcctatatgcgcactcggatgtggagtgaatttgtcttaccctcttttatggcttctgtggaagatccagacagaggtcccaatgtctttccgtgatagtttccagtaactgtcaggacctttgcttggccgggcttaattttcttgacgttgtagccccatttccttgcgatcttgatggcaaggtccacggcctcggagcccgaactcatcgatgaggccaaatcatacccaagtaactaacaaagtaagactgggagattgcgggaaattattaactaggaaatatcttacttacatcgcaaatcttcttgcatagcaagggataggtcttgttctgcaatgcactggtgcacagggcgagctgcgggcactgttcaagcatcgcttcaacgatgcgagggtggcaatggccttgattcacgaccgagaatgcgctaagaaagtcgatgtattcgttgccttccacgtcccagacatgtgcgccacgacccttggcgatgacaatgggaattggagcgtgggttggtgcgcaataacgagcattgatctcaacgaagtctttagttcgcagctctttccccgcagattccgcagttgtagagttactgagacttgaagtttgcgtcatcttggaacggttgagtttcaaaggactatcacaacgttaatcaatgttcatcctacccaacacgggcagaagttttgcttacattgatttgatcgtgtgcgaaatttgccaaaaggggatcgactaagactctaaagcacagtttgcaataaggcgccttatatggcgagtatcatgtacgtcaataaaaaatagtcggagcccgtgcttagggaggccggcggaacgggcgaatattccacaacgggctattgcgcgcttagatacgattacttacattatcttaccgcggatgcggtgtccggcagtagctttgaggctagaaacctgcatgcattacatcttcccggcatggcgatgtcacagagcttccccctggttagtcacgcgtgaggtcagttcaacaaacatctgtagcatgattggacattcagccctctacctctatcttccgcacggaactgttacgtacgagggaaatactttcgtcatgttgacacaccgcacaatgatcttagcgctcgccccattagggagatgccactgtctcatacatgacaaggcttgcatgtatctaagcgcgtgctccgtccttgtaccggcacatgccgtggatgctcccccttacgatgggcgatcaaactctacaagaagacaccgatgttaggcacatggaggctctgactttcaaataacatctattgatactttgtactccctcaaaatccgttgaaagccatatattatccactcacagccctgaggaatcttgtctctgctgtcgcatcatagataaccgacacgagaagctcagtgttgatattcgtgttttgaactctacattatcttctcgaccactaattgacataaataacacttcagtagtccgtcatggcaatcctgaatcaaaacccaacaccatctacttttaaaaaggtccagaagaagtatgaccaggagagacttcgacgattccgtcccgatggcgcagcgcagtttgtcgatacgacgcgttctcccaagttccggcactatgctgctgatccttggtatgatcacgacaagcatccacgtggacgtcaagaagtgccggagacattgcaaactggcttcttgatcgctggtgctgggttcggcgcccttttgtttgctgcccgtctgatcgagtctgggatatccgcctccgagatcactttggtcgacgccgccaatggatatggcggaacatggtactggaaccgctacccaggcctcatgtgtgatgtcgagagctccatctacatgccactcttggaggagacgggctatatacccaagcaccgctactcatatgggacagagctcaggcagtatgccgagcttgtcgctcaaaagtatgggcttgaaccaacaacccttttccggtctaccatgaaggctgccaagtgggacgagttgcagactgaatgggagtgcattctttctaagaaaggtgttgatggcacacctagtgatattacagttcgagcaaacttcgtggtgctggccgcggggatcttggtacatccaaaactgccgcttattccgggcctcgaggagtttgatggccataccttccacacgtcgaggtgggattatggatacactggtggctcaccagagagccctgagcttgtcaacttaaaagataagaaagtggcaattattggaactggtgccacggcgattcaggtcgtcccagagctggccaagtgggcgggacagctctatgtcttccagcgtactgcatcgtcagtcgataatcgagatcagcgtcctatcgaccctgtcaagttccgatctacctgcagtggaaagggatggcaaaacgagagacgggaaaacttcacagctttcacatcgaatacccccgagaagccggctatcaatcttgtcgacgattcttggacgagaatgccatctttcagcgggcttgttggctgtccagtcatcaaagaattgcctttggaaaagacgggagactatatagcatcgctgcatgccattgacttccctcgacaagagcgtatccgcgcccgtgttgacgaagttgtcagggacaaagaggttgcagagggcctcaagccttggtatcctggatggtgtaagcggccatgcttccacgatgagtatctgccagcttttaacaaccaaaacgtccacctagttgatactagagggaggggtgttgatcgtttgactgaagatggcctctgctttgatggcaagacttacgaaacagatatcatcatcttcagtactggattcgagccctggacctcgggaagccctgctcaccgcgccgggatgaaaatcacaggacgtgatgggcttgaaatggacctgaagtggcgagacaacttgggaacattccaaggcatcttcactagaaacttcccaaatttagttctaccaggaggcactcaggccgcacctgccgtaaaccaagtgcatatgatggacgtctatgccagtcatgtcgccaagcttatcaagcttgccaaggatggagttggccggcttgccaaggatggagttggccggcgagccaagtttgtgattgagcccacggaggaaggagaggcagaatgggttcgtaagatcgtcagcatggctcatggtgtggtgctgcgacgttgatcaattgcacgcctagctacgtgaccaacgaagagatattgtccttgacaagtgaccctgaagaacaaattgccagggcgagacgagctccatggacaccaggactattggattatacgcgtgaaatcgagtcatggttcgcggaagggaggcttcagggcttagaggttaaagctggtctggctgaggataaattgctgttggacgcattgtcgtagcatagacttatgcaaataaaaagcatcatatatgatctcatttacggcttgttctcatggcattgacctcggtttttgtctttgcttcggcctacttagatataaacttggtagcacggcactgatccgtgttgaattacaagcccaagatattcggtctctagaactctccgtatacctccgcgatcttgcatagcatgtctatcgtgtgataagagaaagagataaatgaagactataagatattatctagggttaaccgaaatgttagagtcttttcgtatttcacttagaataatgcgagttggagcactatacggatcgtccgagctggccaacgactactagctttcttactgtctccaacaatggcacatgttgccgatggatctaaatctatagcctcggctgcaaatcgacatggattgatcaccgtcggggcacctttctttaccttatcatgcctcatctaagcgccgagtaccgtgcctccactcgagaaagtcatcccgaaagccgaaacacacttgcccaactcggtgaagcaatgcttaatctaagcgccattgtggacacccccacgttttacttgtggccaaagactggggaactgccggatagagagttacttagttgcccaaactcacggtgggtgggctgcaatttctgggcacctgtcacagccaaatctaaaaagacatcatccggtgactcaagcttggtttatcccagcgttgtgtgaacttttcctgacttctcgcttctttcacttcatctctagtaatcccccccgcccaagttgtgtaacaaacatggcagccagcaaaccccagtccaaagatgaccaggtcactgaatacatcgcagtcggcaaattttcaaaaaacgtcgtggcagctgtaagttataacctatactatcatataatggccgttatgggtattgacctcctatagtgtgatgcagtcgctgcactctttcccgcccaagtcgtccgtgccgcgtcgtctgcctacatcgaggctcagaactcttactggaatgcttctcagcgacagaaggaacctgcttgcttcttccagccgacaagtgctgagcaagtgagtgctgccatagtcgaagtggtccgcgccgattgcgcttttgccattaagggaggcggtcactcgtcgaacccagatggttccagtatccaagacggctttcagtttgatctctccaaactcaaccatattgagatctcagagactgatcgcactctaagggtgggacctggggttcactggggctcccttctcaaaattctcgaaagccgcggcctgagcgctgttggcgggcgagatgccggtgtcggtgtcccaggattcgtgtttggaggtaactacttgatgctattttcttcattcatcccttttaagccgcttcgactgactagtgtccaatcacaggcgggctttcttactactctacgcagcacggctaggggatcgacaatctcatttcttttgatattgtcctggctaacggcgacttgctcacggtagaccgcgattcccatcccgaccttaacaaaacgctccacggtggcggagccttcaatttcggcatcgtcacaagcttgaccctgaagctacactcatacgatggcatgtggggtgggatgaacgttgtagatgaagccaacttcgatgcagtgtgggatgcgtatgataagtacacttccgacctgatagaggagaacaaggcccatctgatcatggactttttccagctcgatggcagaatggtggtcgcgaaattcatgggtttcctcgcaccgcaaccgaatccggccattttccaaggcctttgtagcatccccaaagttcacgataccctcagactggaccaatatagtggtctggcaaaagagatgcaagaggtcaccaactgtcgaggtgaaagaaatacctattggactctagccatgcgttatgatatcagactgctcaaggattgttatgaattgtgggctaggatgacaaaggcgtacgaggatcgattcagattcgcgttcgacgtaaatcatatcacacctgcgatgagaaatcaagccgctggccggggaactgggaatgtctaagggcttgaaggcgaagacaagcctatgaccaatatcctcctgactgctcgatggtcgcacgagtcggaagaccagctggtggcgtccattctccaaagcctgggcgatgcgattgaggcgacggcataccgcgaagggaaaggcctgagcttcaagtacatgaactacgcgcatcactatcaggacgttatagcgggctttggagagcaaaataaagctttcttgctcaaagtggcagccaaatacgacccaacggaggtattccagcgcctgagacaagggcctttcaagttggaaaaggataggtgggactaaaagcagagtctagttcagcagaaacggtagacagcactaaggcaacggaatgagatagcgagcatacagaaactgcaactttagctaaaccgctttggcatgtcgtttaatgctgttggtctactttgactcacgtgaggagaccaactgggcctcagcctacatgataatagttgagctcgtaatcatttatgttagttcgacagcgatcttgataccgaaaacccgtagttaagtaactgctattagaaggagggcattgtctgagatattcgcaggtgccttgaagactgtgaactcggacaaattcagtgtgtgctccatcaagggtcttgctgcccaacacctgggacttgacacaacgcgagctattgtcattgctgcaatagaaatattccccaattcacatagccagtctcttctcaggttatcaaatgaatacaagcttcagagtcaacataggaagcatactgtgaagtcgtggatgccgaaaccaccctctcaccgagtttcatcgtccgaacggcattgctcatggctgccacaatgccagagcgctcatctcttatgctaaatcctacaggagattcttgattgcctcgttaaacatgagttcgcgtttttcgttagcttcagagaatactaagccaagatatttgaattattcaaagatgcctatcgcgagagcttgtcagatagttgtaatatatgaaatgccaaggcagcgcccaggaaaaagcccaggttgaagccctgtagaagtgacaagacaataaaagtacacccaatcattgccaccaggcgcctcagtattctagcagtgatacttcgtgctatagcaaggataattcttgtcggaccccgaataaaaatgttatcgtgttccctaaatggggtgtgactgccaatgtcatggcctgatatgtcctcctcggggtttccctcgacattgatatttagaggttcgtttgatgttctcagattcagaggagcataaagggaaccccccaagtaatcgcttaggggtcttgcgcggcttaacattccgatttcagccacatatcaggtgccctcttcacacatcagtgctggctgtcagtgcgtggaaaacaacgatcaacttacaaattccaaattttatcgatgcaaaaactggtggctcaaggagactgtgtgattaattcgccttttgaccttgctggtaaagaaactctcgtgcggggagcgtggcattatgcaggaagctgttcagctggccaataataaggtatcaacaagaatgatgatatcacgtgaggcatttctttcagtcagctgagaatcctgcctgaatacctagccttgcttgtttttcgtcaatcaaaccacctcttgcgtactcctccacgtggcccagataccatacttggcgtcaataaaacggactgttgccaagtatccaccgatcagcatggctgaggcattcgcaatcattggtctcacgtcgagtatgctcacatttattgaattcggcctcacaataacatctgctgctcgcaccatctatcgaacagtagatggcaaggtgcctgaaattcaggagctggagagagacctagatgagattgatggcaggaacaaggaagttttgaagcgcaacactactagtccgctgtctaaagcggagcgccaaatagtctccaccgttaaggaatgcgataatatatctggcgacttgagaaaactggttgcaaggctggctaaaagaccagctgcgaaatccaacgcctgggaatctagccggatcgccattcaagtcgtcatgagtcgaaacgagctagaaacgctgaggcaacgtttactacaacaggacaagaagataagagagggcttacggtctcttctacagaggtgagaatgtgcttcgcattgatttattccctaggtgcccttgtcactatttaatatctacttgttcttttattttcaccatcctcgatctctataccatgcatcataggtggtagccgctaacgttattcacgcagagaccgccattcggaactaattgaagcgctgtcctctatccagcaagcccatattgtccatgatatcaatcacgatatgaaatttgaaaaccttcaacgacagatttccgaaatatcccgcagcgaagaagacaacctagctaagttagtggctgaggtgacgagtctccgaactaaggtggaaagcctcaacaaggaggcggagctatgcagaaagcaagccagggtgatcaaaagcctctacttcactgaaatccatcgacgatgggataaaatcgagggtgctgccgagaataccaacgcatggctctttcattcgtcagaggtttctttttcttcctggttgggatcagacagtaggagcatgtattgcattaccggtttggtaagctgccttacccttcacattctcatgcatcaacatacgccttgactaatatttactggtgtggatagcctggtagtggaaagtcgaccttgatgaaatatgcgtacgatcatccgaacacgatgcttggactcgagaaatgggcaggctcatcaaggctatgtcgagcagcattcttcttctggaaccaagggtttgaaatgcaaaagtcccaagctgggcttctacaatcactcctctatcagatcatgagacagattcccagccttgtgtcactcattgaggaaagcaagcagctccacgagatttggcaattcagtgaactgaaatcactattcactcagatcatgtcggagactgcactcacgaccaagttctgtttcttcatagatggacttgatgagtatgacggggacgaggaagatatagccaagctgctttgcttgatcagcgaatcacctcacatcaagatatgtgcttccagccgacctcgcaccgtctttgataagacactctggtctggacagtattttctcgctatgcaagacttcacgaagaatgatatgagaaattacgtgcggaagaaacttctagaaaattccgagttcaaggcccttgaaaagttagacccggattgcaccatggtgatggacaaaatcgccgaggaagccaatggcgtgtggctctgggtcgacttggttacaagagatattatacgtgccgccaatcggaatgaagggccgcgaaagttccacgagatcgtcgcaggatttcctcgcaaactagaggaatattttgcgcttatcataagccgagtcaatcccgtttatcgcaaggagatggcccgagccttccttgtcactatttacgaggtacaacctttaccactttatgcattctatcttctcaataaagaggaggaaaatgcagaatatgccagtgaagaagaagtctccagcctttctgactccaaggtccggaatatcggccagacttggaaagcaaggatccataatagatgcagtgaccttcttgttgttgacgaaggaaagcatcctgtcttcttgatccagccagtagattttcttcaccggacagttcgtgattttcttcgagattggtttcaagataaactcgaagaagagataaaagaatccttcgtcccgccaatttcgctttgtcgaataatgctcttcttcctaaagaagcagcctcaggaccatctttcacatctgatacattataatcgcatgattgcgctcgttgatgaactcctttattacgctcgagaggctgaaaagcatccctactgtcgacactccgaagtatcgccagtagaagatatcttggatgccgctgaccgggtaaatagttccttgatgctgaaggtcatgaaaaatcactggacccatgtaagagatcccccaagatctcgagggttagacgagtaccgcgagagcggtaaatgcaacttccttgccctggccatccaagcgcgcctcttcaagtacgttagggcaaaacttgaagctgacccacgccggctggtgaaaccaggacgaccacttttggactatgccctctgtccccggcgagtaacgccacttgcactgccctatcactcgcgaagggatgagcccaacattgagccagaaattgtttcactgcttcttagccttggtgcaaaccccaatcaggtggtgtactctcatgaagatcgcaccgtttgggcgttattcttgatctcctgttgggagtctgctaaacgtggcgaggccacagaggtatctaaaaaggcatggtatgaagttagcgagatgatgataaagcatggagcgagccgcgattgctttaacaacatcgagggacaggaactgagcattgacaatgttctcagcacaattttcggggaggaccaggcatcaaacttgctggaacagattagcgaccagatgttcaacaagggaaatacttggaggggttggatttcgtcttttttctgacacatagtagttctcgaatagatttacatatatggtcagttcgacaaggattaatatctatgatatacttcaatattaacaagggtgagaagagagaggcttgcccccgccaacggccattctcaccccccttgggctcctcgtagacgctttgcttttaatctgcgaggaatgggcgtgtgaagcggcagtattaagtttcaataagtattattcatcatatctaagtatgcagtactgactagtatgctcatcttcctcccgtagtttccgacttcttatatttgactttactcaaaacaggattgtcccaggtcaaatattcatagtgttgagatgtcgggtcttgcaccgccattgctacttttaaccctgtactcgaactcttgtccgtcgtagtgtgcattttcgaggaaacatcgaggtcgagggtcattgaatcgcttcgtgagggaaatttttcagtttcaaagtcgagattatctgagaaatccggtcacctaatatgaattcagtcgctggctcgacctctctgaatgatcatgcacaactgagaatggaaatcaacggagacacatacttccattgcaagaaggagggcaagtacgtactcctgtacgcgactgccttctacctgcccgtcacgtgcactcgcctggcagccttcgttgtgccagaggtacctacctttcatttgtttactttgctgcctcaggctccctcttctcctcttctctaccctcactttggaacaggagaagcagcactttcttcttccctcgtcatctctcgttacgttcccaaagtgacgtctttcgatccaactatcgtgctctcttctcgccatggccccaggcggaggcgcggaggaggcaacgcgaggactcccatttcttcctaccctcgtgctgcaccggatctgcactttcctttgcacccactgcgagccaacacttcctgaactcgaagggtgccaggacgaatgtcaaggccacaccacgttgagaaatctttgccaggcctctcgactcctccgatttgttgccgagccgatcctctatcatcgcgcaaaattcaaatatctagcgatgcctggggttcccgatcacttcgccagctccgcactccgcttcatccagaatattcaagaccgcccacgacttcgaaactatgtcaaggttttggatgtgcgggacagcgctcgtcgacaccgtaattccgacatcgatttcaaatatttttctcgccacgagtggtcaaatcgacgaccagtgacagggcgcaacttggaatacatcaaccaacttgctgctcctttcggaatcacttgcgtcgctgataatttcgttccggatcgcctggtggaaacatttgttcaactcatgctagtcttccttcctggtttgactgagctaaagttctcggcacaaggatgctggaaattccgcctattgtcaggtgctctccagagaaagaactcgaaaataccggatgcacttctttctaaagttcgcaaacttcgtcttcactttgaagtcccgtcatgcagatgcgatgagtgccatggatcagatgtaagattgttcgaaagaggcgccgagaagctcctgcttcaagctaccgcgaagaatctacaaactctcgtctgctccgttgcagcgctgaaaatcgcgcctgattcacctctcctggagtcgttgagggtagacataacgggcgactggcctttttacaacaacttcctggcccaactcaaatgcctacgccagttttcttgcaccttttccagccaggatggccctgtgccagatgctatcatgaaagcgatcacacctacagcccaatccctcgaaatgttgaagttttgccttacggccccatggccccaagagccttctgggtggaatagtcttgagtgggaacctgtcgggtcagaaactctcgaggatcgttttgacctcatgcttatatcacttggaaagttcaccaaactcaaatgtctttctatcgcggccgagatgatcttttcccagacaacagacagaccttatacacatttggcacgtcgacttgagaggtttatcggttggctcccaaactctctagaagctctccatgtcaacacgctcgaatttgggccagatatagagagaattctagacggactcatagatgcgttgagaaaaaatgctccctgcagcctgcacaagatcctaatctcctcctccgattgggcaaggttcaaaatactccgcctagatgaatcgcggggctcaccccaatggtcagttagaaagttgttggaaccgcgtgctggtattctggaattgaatacgaactaaaatccgcaggagggcgaatttaactggtaaaagattgttcgatggatgggtagtgtggaatgataatgatgtacgtgagttagagacagagagaatcacacggaaatgagaatctggaatgcttttcacatcaactaggacctttcttgcaccataattcccgttttgaatgtggtgcttttttaaacggataggtcaataggaaaccccataggttcttgttgggtgaagaaatcacttcttgcattacatcgtgcgatcaaccctcatccaaattattcttccagttgagaagaaaacaacatggtcaccggaatttgaagatggccgagttgaattaagcgtgcttgtgtagattctatgtgatatatgggcctgtatctgaaccagttggagggccgagagcttcggaagctgtgccggcgccaacaatattttcaccatatcagttgcatcaaccacgtcaaagactatgaacctttgcattagagcacacgttttctatctctcgatgttggaatcgtggtattctatagtctagcagttcaccgctctgtgtcttcaccaaggacaccgtgaaacgctgtagctccgcccggcgtctcctctctgcgttctagagcagtgaatctgagccgatcacgtcccgcggcagacagagatggtgaatcgcgtcgctgtgggaatgtatgatgtccttgtgtaattgctcatacttgacttgtacataggcaactttttccgaggatgctgccacatcgtcgaagttgaagatcgcatgtgcagtagcatgtgagggtgacttcgctttctttactacctcggctacactttgtcttgtgataaatgaaggcgcaacattctctccattccagagcactagatcctgcagcttgggcatccccagcgcgtcctgactgcagcgagctctatccgatgtccatcagcgccatctccaggcgctacagcgtcagactcagcatagcttagcgtcaatgatggaacataccgccctgttacaattacgccatggctcaaagacaaaattctgtagccgaaggagactgtggatcatacgtcgtactcccgagaaacggtattcaagacaacaaattgatgactatgtgtagatttctaaaattcgttgtttcctcaggcaggaagaatcaagccgcctacggggaaggagcatggcctgtactccaaatttgtgtggggtgggtaaatcacaatccccaaacttcaccggtttgtcatcatttgccgtctttgcatcatcactatgcaccgtctccgataggccatccatccagagcaaaggccttgccatttcttccagctacgagtccatcaagtaatcattccagggggccaaaggtactgattaggccttgatctccccctcgccatgcatcccgatgacgggtcgcgaccgaccggcatgctcaggctctccgtcgagcttttggaccagattttccggtgcttcgaccactctttcgttgaccggggcgggatcgacctagatctcatccacgaacagtcggcagaagatcgccgaacgatccagcacctgcggctagtgtgcagtcttttcaacgatgtggcatcaccgatcttgttcacggtgctgagaatttctctcgacaagcaatccctgcaccatgctcaatctgttgtacagcatcccatcttcgggacaagtgttaggggtatccaagtctacctagaatatcgcccggcgtcgcttgcctcggagatgagggagtatgtcgagttccaaaaacgagcgctgggcgactacgtcaattatcggacgggatctgacgttcggagtggacacgttcggtcatccgacgggcgttttatcaaggttgatggagaccaagaaaaaagagacgaagaagataaatttgccatctggtctccaggggatgaaaccaaggctttcctgaactttcgagccttcatcgcggcctgcgaccggttcatcaagcatcaggggaatatttctggatccgggaggttgtttgctgtcaacgaagggctggttgatcagtacgtacagctgatcttgcgatccttttctgaatactcgaaacgttacgacgagcagatggagcttatcgtaagccagtcctttgttagcactgtcgcccagatagtgtcccgcttggaacgccccattaccctgcaagtcgatgatggtgaacaatccgaccagaagctgcccgtacgcggccgtcttgcgatatgcctcgacgacgaagcgcttttccgtttcttggtagcgccacacaaatgggtagatgccgataaagctggaggacccaagttgattactccagcgcgggtcgtccctgacttgtctgttgctatcaataaagctggaggtgtggtctcccgatttgagctctcatgtttgcctgacctccatcatcttgatacagaattctctggaagctcggacatgggtgatcgtgatgcatggggtgatctccgggtatcttttcgggggcttaaggttcttagactgaaggggatggaattaaaggcgcttagactcaaggggacatcctttattcagcttcttgtccaacgccgaccaccgctggcgcgggacaaaagatacctggagaagtatctgcagacgatcctatccggtcaatttctggaagaagtggtattggacttctcacttcttactgggcttacatacgagcacggggcaatcatctggtgtccactagggtccgtcctccaaaccagccgcccacaggctatcaagattacgatacgatgcatgtccctatcacaaaatgaattggaagacttcttccaatcattgggtccaaagaccgaaagtctttgtttgcagggcatcaatctggtagacggaagctggatacgtccgctggctattttgagagagagggtagcaccaagatgtgtgcaggggacattctctttggtcctgaaagacctgactggttctgaacttgggccgatgaagagaatgacaacaggagctcctcctttaaagatgaacgaacgcgaggatattggcatactggaggtagtcactcggtatgtgagaggtgatggagtaacagagaatcccctgcaagccgaagcagaactttcagactgaatccaagatttgatgattgattaggtatatgagattatgaaggaactattaagacaagtctttttgtcgtcagtagacttatatataaatctactcagcgcatccggcttctccaggttgacgaattaaccgaggattctcttgaactctgtatccaagccctgccatactttgtccacagcacccacatccctatatttggcaaggctgttgaatgagttggagcacacctcacttctttcatcgacaatgtagacaccacttccctgcaccccatcgctcccctttaccacctcaagttttccctcaaggggtactccaagcgcatcatccccatctttggggggaaactgcgcgctcacacacaaaaaggtatgtctctcacccgtctcctcgggaccaatccacgagtttcggtatctccactggaagagatacttgagcggccgcaacatcaggccagattccttcctgatcaggttcgtcatcaccggaccggggaagctatgcacgaacgacacctccggcgcttgtctcgccagcccttcgaggccgagcgtcattgtagtggcggcatgttcccgcccgtgggcagggttgaccctacgagctgggatatcatcgagatatagtttcccttctttgccacctgccatcacggatacgactcggcggagggactggcctttgcggaggagaggcaagaggttctgcgccattcgcaaccgtcccataattgccactgccgtaacgtgtgggaggccctcctcagtggctggaggacatgcgcggttagcatttatcctaatctgcatatttcgcgcacattggcatgtggaatcatggccacttactaccgagtttcagcgcaccctggctcatgagtagaatattgatgctctcctcctgctgcctgattttctcgcatgcctggtccacattcttgatggagctgaggtcggctttgacgaaaatgtattctccttctgcatttttctccttcagctgtttcgtcaataggtccgcttgctcctgtgagcgaccgagaaagtagatcttgggtcggatggcatgctcggcgaaatgaagaagggtgaagcttccgatgcctgctgtggctcccgcaaagacggcgacgaggttagggatggccagcttggaattggtgctcttcacatcatcgagagaaaccatggtcggtgtattgttttcactttagcctgctctgaacgagaaaggaggatgggcaacgatggattcttttagaatatgggcgacagcggcatcgcatcatcatacttgtataatattaatacttgtttttacgctctcgcggggaaattcttccctccgacatcaacataccccagcatcgtctttgtgttaactgaaataggggtcgattctgtgatgtccgcgtatgtgttgcggactggcaaagcggaggggttgcggagtttcgactccagcagccaccgattcggcttgatccatagccgacacggaggagacgcctgccgacctccgacgagccagctcgctggtctgacgggagagttcgagtgtgaagttaaaaacaacaatagaagatgccagacccgatatctcaatacaatgaatatgaaaggcagaaataagcttcgttagcccagggctgcagttatacgaaagaataaggccgggaactttcataccgatgactcacttgccatggggatgtgtcgctcgtcgaatgactgtttaatctaccctcttttatctggcttcacactcgtcttactccaatccaaacacttcaacacaccaagctccagtcaaccaacccagtgagtgcccgtacccccttggccagagacacttgatgcccaaggccagattactgcagaaatttgccgtcatccagaagaacaagtagggcagcatgacataaagagaggaagcgatcagaggagataagcatcaatagaaatacttcttaatcttccaagccacaatggaaaagagcatagtgggaggccctcaaaggtcaaaggcatttcgattgataccaccttctctaatcccttcctctcctcgtgtcatgctgtcctacctgttcttctggatgacagcagatctctatagtgatcaatctggccttgggcaccaagtaagtgccgagattagtactaataaataactggcgaattcttgcccttgtcggcgaaggatagaagacgagtgtacgaaggaagccaggtgaaagagggtagcttaaatagtcattcgacgagcggccgtcctgacggcaagtgagtcgtcggcatgaaattttacggacttttccttctgcatgactacagtcttgggctagcaaaggctgtttacaaaaaaaaaaaaaaaaaaaactttcgtcctcattgtgtggagatgtcgggtctagcatcttctattgttgtttaacttcatactcgaactctctctcctataggctggcaaacgcttctgaagcaaaacgagcctcagctgcgttttcccagcaacccgtggttctcctccaacacccaacggagcctcgtaagattacgccgcacatctaccagtatcagggctgccacactaatgctaggctgagaagatctcatgaaacgaattttcgcggaatgctaccgatgttcggatgagattgcacgagatactcgtgtgctaagaaactggggcggatcaaatagactctggtccgaatgaacctcatcaatcacagtgtccccaaaccttgaataaagagcggaagaaaagaatcaaattagaacctcacaccatctccaaccaaaatttctcgtacaagcagcgcaaaataactgagcctctgattaaagagtaaccttagtgcctttgatctcaacagtaccgctgaacgtgatccgcgatgccgtgctacttccctggcgcccgtggaagacaacattcttgccattaggatcaatgtcgaagcctccagggccgatagccttgtacttctcgttgttcttgctgcccgtggcaatcaacacgcccccccacttgaacggccccgtcactgcatcagcataggcatactcggtgtggtacttgctgttggcgtagcagtgcgagctgtagaagaggaagaacttgccctccttcgacttgtacagggccgggttctctgtgacgccgtcgtcgtcgtaggtctcgccgctggcgaacttcttgggcgcgttggggttgttgtcgcggttgtcccagatggtcgtgggcgagccgaccacggacagcccgtcggccgtcatcttctggaccttgaggggtgtcggcttgtacttggggccggtgggcgccgagccgcccttgcaggtcgtcgcgccgccgaggccgttgccgtcgaccttccaggtgagccagcggtccttgccgtcgaagaagccggcgccgtcgatgacgccgccgttctcgtggtcacagacgagggccttgtcgtagggctcgaagcccccggcggaggtcttcgaggtggcggctccgatgcagcgcttgccgtccttgtgcacggcgctgaagtacaggacgtatgagccgtccgactgtcgggcttggtcagttcacgaggccagtgagagtcgctcgggaggtttacgtacaagcttgactacgtcaggcgcccaaaggcctgctgtcgtggcccacgaaggtcgcttcttcagtgcgtctcccacgtatgtgaagttgaagccatcttgcgcagtggcgtaggggatattgtgtccgttgcttgtgccataggctttccaggagccctcgccatagatgagagtggggtcggcaaagctcttgccttccatcttgccgcggacagcgcgagtagagagtttggcatcggtaaagatcggagtgatgttggacagagacacctcaacggtgtcggtgttagcctcagcggtaggaagagcaaagcttgcccctacaaggagcgagctgatgaaaaggcccttcatgataaagaggaagagcaaagaaatagaaatatacttaaataaagagatatccgaattcgagaaaaggaaacaaaagagcgtcagatgtgtcaacaaagctgatgagaaccaagtctagaaggacatgccaaatcatttcgaggggtgtggaagccctttatgcaggtacggaatggccgagcatcgcaaaggaatagctataattgggatggtaatagcttagcgatcattgctaagttccaaaatagctcatatctcattcggcaatgcccttagtggtattgagcagtgtttcgtttagagtggaagagaaccctgccagatggattgcatgagttcggcaatgtccctgttcggaaagcactaagcctgcttttgtagttgtcgcgtgcattgcctgatccggggcaaggggaaggactttggtgttgaagaggggcggcgatcaacgtaatataaaattagttgctcggcatgtcagcgtggtggaattggaaaatggcaacgatagactaccatgcaatgagaagcctacgataatcctatagtattgagtcaaatctaggcagtttgttctaaaaagcggcgtagaagtgatggcttcatattgtgccttttacttatttccctcccggtatgcctgaagagacagccttgacatagagcgagcgctattcatatgatcgaaccaagtagcaggtttcgtcttcgcatattattcctacccataaaatatgaccaatgacactgcttgctttgaagtaatagaaatgtccagacttagaagaattagatttcctaccggattcactcgtgttcaaagtgaactcatgacgatataatcctcagcctccctaccttagaagcaagctaggaatttggccaactctgccacatgtgaggcctagcaaatgcctactataacgggtgagaactatccaatctcagatgcagaaactacttagagtagcctatgacataactcgaacattccacttgagtaactcagtcagactggtcagattcaaaagtattttcagattcttctagaactacaatcatcatgaaagccaaaatttaggttcccaacctttgaaataaccaaacgcccaaacatgaaaacattactgggaaatctcgtgctgaccgctccgaatacaattgcaggatttccagagccaccgatcccgattcctctttatagcgacaaaacatagtcattgaccggttcccagaaaaaaaaaaccataataccgttggaacctgtggtgccgccgcaagctgagataaagcttcaattaacgcgctcccccatgctgataataataatctcctggaagttccattggcggaggagcccatctttgttgttgttgctgctcgtttggaccaggaaccgacgccgtatactgctgattaaactgattgtaatagtccgggcctgtcgggtactgccgaggtgtcgcttgttggttcgctaccggggcttgtgcatacatcggatgtggttgatagtcaggcggatactgcggtggctcaggaatcatggacattcgttgctgtgcaggactctgcgataccgggcggtttttctgtgacagatcattggggttgagcgtcttgagccggccgtcgggggccatcattgccttcaatgcgccggaatcaagcagctcggccttccgaatgattctgtccaccatgtccttagaggctgctttcgcttgcgctttgacgaagctcacgatactgatgttgcaccgaatctcgatatcttcgcggagatagagcccatccgccgggatgtcaagcgaatcgaacccgagctcacgatgctctggcggttctacgccaggctggttcccggcgatgcgatagcgaacccgcatgtctatgccgaacggggcgtagatgtgagtctgcagcccccacggcatgtcgtggaagcagccgttgaacgtgatctccttggctccgaccttgccggtgccggggatgacctgtacccgctcgtggatggcataccaggtgctctgcatttcgtccggggacgcattgtggggagggctgatcttggtgtggcccaggaccagcgggttgagtgtgatgacttcggagtgcgagtgcaggatgtcgagggccagacgccgggggatgtaactgggtattggcgtcaccaccgtgaagacttccttctttttaagtagcttggacattttcgctcctctctgccagttattcgatctcaggccaggtatgtgtgcgcgctgtgaaccaccgcgacgggttgataggtggtggaatctgaggggaagggtattggacgattgatgtatgatggagaggagagagacgacggtaaacgtcatttatgggtgatcatgtaagactaagtagaggccgttggtttaggacacgaggagcggcgggtgtcgaaaccatccttgcaggccatcattgctatttccagcagactaaggcgcctgtgcttactggcgtctgctgactatccaatcagtatattcacagaatccaagatgacgttttagtttcgctcggctgctgctcaaccggcgcttacagctctaacctgaaacggttcggtcgatcatcgcctcactgctgcggacgaaacactgcccccaaatccatctcgtcgacaataatgcatataattagaccggataggtctgctcgccatcaagactgcggacaaactcaaagacatccgatgttgtataactggggattcgctggaaataccgccatttcttggcctcgcttgtctggccggccttgaggatctgccgcgaaagccagacgaggccgggagaattccgtgacacgcccagccacttgcgctcgtcttctggcatttgcttgattgcaatggcccagagaagatcccaccgatccagcgcgcggaagagggcagcggaatgactgtctggaaacttcgaggagtggaggttaaagatgactggcataaaagctattcgaacgttaggagatcctaaccgagtgggaaatatatcacttaccgcagctcatcgcgtgtaaatgatacgggctaagttggctggatatcaagtgtcgaggttcggtccagtcatcgctcatcaattcggacatttggtcgaccagacaatgggagctaaccaaggtgtctgctttccggttgtggaaatcctcttctgtttcagcatcccaaattcgtgcgctgcatggcgactgaccgcacatttccgagagcagcagcagggaaggatgattgatggccaatgtcgccaggcagtcgatgtagaacgaccacgatgcgaggcggatcttcagctccttccgaataaaggatggccatgattcatcatcatcgtgtctgatctgggctaaatgatgatcccttataaccctgatgagcttaggactgtacttgcagataaaagtgcgtctaatctcctgatctttcacccatgtaccgaggccaatcatcaataatgcggcctggcagtactctatcaaattctcaaacccagaatcggtatctatttgcttctgcaatttgctgaaaatatagggggcggaaatgctgtggaaggctcttgcttggacagctggatcaggttcggcgccaggcgtgtgcgaatacgccgcgcccatcatcgcaaccgaaagaagcaaaggcaagggagccttgagaatgtcgaatgttggccaatggatgatggggagctgataatgtctcttccgcgagaaagctatcacaaaccctcgcacattctcgcttgtgaacagactctgaaaggactcgcgctggaaggagccactcagcttcggtttcctcaaggaatatgcttccaattcatgagaaaggaggtctagacggcgcccgagagtgtcgcccgacacgattggcacaggtgatccaggggctccaggtccagagtcatcgtacacaccatccagtttcaagtaggtgtccaagaacgggtcaatgtagttggatagtaggagcgccgggtcaatgaaagccacgggttctcctgtattgctctcgggtgacattctggtcgaagggccgccgacgctgctttctggctgtcgagcagcatccctctcgttctcaaactgtgtcgtcgaatcaaggttcctcagcaggaagggtagtccgaggtctacgcctcttccgggacctggcttcttggaatccacaggctcggccattgactgacgatgagatggatcgctgcaaagccagctatatgaacagtccatgctccttgagctacagcgtccacaaggcttccttccatcacactggactttcacccgggagcactgggtgcatgcccgaagcttccggcctcgtctggcaagtggcggcaggggttgatttcccttctgggggcaggtttttgcatgcctccgggccccgtctactcttccaaacgacttgtggcagaatggacattggtgctgccggactccgagcctagggctctggccgccgttgtctacgaaagggagctggcagatggggcattccgagggagcgaggtgatttgatgcggaggagaccatgcctctacttgcatacagcttccgacttactcagctgtatcgggctaccggctgtaggtaaaatgtagctacggatgtgtagagaggaagagaattagagatgagtgaatttcccgaggctcgttgtgccaaagcgaagtacgaagtggatcccggtgtcatggtggtgggtcaaactggtgggatattcccgatgccaggtcctcctataaagaagcactgctcactttcccggtccattccattggccaattgcactagatctttgactgcccaaatccctcgagaatggttgttgctggtcgattgaaaagtatgccaggttgtactagatcccaatcattgagaccaagcactaacacttgatatctagcaagcctcagggctcctaccctttgccttcgtgctatggctggcaaacgaactgccctcatagctccctcttcgatatgttttcagcgccagtttacccaaacgtcctcattctctcgaccttcgccgaacatggccctctccaccgagcaacgacctacaagtgtaatcgagcatgtgctgtaagccactgccatccgtgatgatgaaacagaagaacagaaactaattagtgctaggacaacactagatcagatcgttgcctgggctcgaaacggctccatgtggcccttgactttcggcctcgcctgctgcggcattgagatgatgcacgtctccatgccccgatacgaccaggatcggctcggtatcatctttcgagcgtctccgagacagtcagacgtcatgatcgttgctgggaccgtgacaaacaagatggcgacagctgttcgacagtgctatgaccaaatgccggagccccggtgggtcatcagcatgggaagctgtgccaatgggggaggatactaccactacagctatagtgttttaaggggtgttgatcgcatcttgcctgtggatatctacattccagggtgtccacctacaggagaggcgcttctatacggggttttccaattgcaaagaaagatccggaagacgaagactacccgcatgtggtacagacgttgacggcactatattgatgttgaccggctattcaactagaataatgtatcaagattgttattagattgtgcttgatgaaaatagacagaagcacagctataaacatctcaatcccttataaaaatagagtttaaatatagaagcaagttcgctcatcctcacaaaggtcagcatgctcagtgatgtatagggtaggaaaacattatacttcggcaattgccgggagtgatgagatatccgaatgcgggccgcagcagagcccatcaaggttgtccagtcatatgcatctcctccttgtcatagattcttcgtgttggtggataatgcggaaaggcaacgagcagcacgtaccgattacgaaactgcggacatcatcactgagagcttgcttcattagtggagacggaattcggatttaaccaactgattaatcagtcgtggagacaaggctgcttagccaatgacacattccccgatgatctaaaattctagatccctgaaataccaatgtaaagctagactggactgggcctagcgtcatgcaacctgctcacattcaatctagacctagttcggcgatggcttcatgctcaggtgttaatcaaggtcaagaaggctgaattcaaactgtattcgcttgttggctggtcgattagattcggagttaggagaacgaaacaggcagttgaattgcgttcaatggtatcccagaaatacatatataagggggtgccagtctcactctacccttaagagaaccatcaaaaccacccatctaataccaggcacacactattcctaccaagatgacatttcacccagactctcttccaagcctctcaggcaaggtctatatcgtcacaggtggtaccgcgggcatgtaagcaactgacttcagacatccctttccgccatcaatagctcactagatcccagaggctactacacagtcgctcgtctcgcacaacgcggcgctcatgtatacctttgcgcgcgctcagaagccaagggtcaaaaggcaattgaagggatacaatcactgtatcccaactctaacctcagcgtactggttatggatcacatgtccctgcctaccgtagtggctgcagccaatcttttcctgaccaaggaaacagcgctgcacggcctggtgaacaacgcaggcatcatggccactcctttcgaacttacagaacacggctatgaagctcactggcagatcaactatattgcacactggttgcttacctcgcatctgctccctctgctcctcgaaacatccaagacccttcctgccggtagtgtacgtatcgtcaacctgacatccgggggccatatgtctgctccaaaacccggcattgactttgaagatacttcgctggcaaaagcaaacccgataacccgatatggccaatccaagctggccaacattctgcacgccaaaacgctcaacaaacgctacgggcctgggtcaagtagtgccaagaatggaaagggggagatttggacctcttcagtacatcctggcattgtagagtcggagctggatgaccgggcccttgagatgccctggttcatgaccatcgcttccggcatcgcccaagccattggggctagatggccgacggataagggcgcgtggactccagtgttttgcgccgcgagccctgagatgaagccagaacagagcggagagtactttgagagaatcgccaagacgggaggcatgctgcagagcgcgaagtcaaaggatttggagctggctgagaagttggaacgttgggttgaggcggagatgaagaagcagggatatatctaggacgtgcgcgctcttggtcaccatccattctttcggacagttccttcttgatttcaacttattaatttttcatcataattgtttcttattctcctcgctgattcacttgtcatttataaagaatattcttttaaatctactttttacagctgcttgatcagtttgtctcttgcatagagaatgtgggagaggtattaatcgccatctagggacacccaatgctgacctttctaattgtattctatagaaacctaaaactaggttctatccttatgttcatggaacttgggatcgaattcatggatagggtgggaatctttcttctcccggtctccttttgtatcccttgtaagtacagaggccgaaaccctttaaggcaaccacgaatctttcactcaggtcttttttaaacaaatgtaaagaaaaacacgtagtgaaattttagcaaggacgaaaaactatgagtttcctcttttatcagtttggtatcacaagtgagcatttgatcctagagttgttaggggaaatcaaaccttcacgcggtggcggcaaagcaagtcaccaaatccaacaagttgttcatatatgaagctctgaatacagcgctcgttggggaagaagcgtcctccgacatctgcatggctcatcttggtgtagaagaagttttcgtggacccgagggccaacaagtcattccagtacacatgatgtagatataccatgccccctcaaatcccctcgcgttttccaggtttcatcagatattttgcttactgttcgtatgcgatttaactgaccatgctgcgttccatgaggggaatgtgttggaaggaacttctctgtctcgggaaagcctagtatacccgatatggcttgtctgagtaaggtatataggaaacccttgcggactacctaggcagttcctttttctcaaaattggttggagtcgtggatacctacacagcggtggcagaattatggatatgcttgaacgcaacggtacgtagctgctcgtaaaactaggatgctcggcgcaattgtaccctgaaaaagcctgactgaaccgtgccgtgatggatgccgtcacggtggggtcttgtccgtggtatctcaatgtgggcataccaccgtagtattacggccaaccaagatgtacccgcaaactcagctttgggctgggacgacaacactctcgaaggaggcctctccagagaacagcttcgctcaaatcctctccacttgtttcgacccaacatccattgagaccacgaaatgaagtctgggataaatctgaacttgaaaggcacccatatctcactctggcattccgctacggtcaccacataggtgtctccagtcgccgtagtatagtttgaagtcaatatcatgtcagtttgtctgttttctatttcaagacacaaggttcggaccaaggacgattatttctactgcactaagtaataactgttttgtctttgatcacgagtgatctttatgagacccaaattacctgcatatctctccataaaattgaaaagcggagagtttatgagcttaatcagttgtgcagcaggagtggcccttctttcgtccgtactctgataataaaggcattagtcaggcctcattatccacctgtctaagttgccttggccatgcaccggcgtatttcctgacacaatgttgtcaaattcagtaactatcggccctgaggttacccttaaaaaccttgattcctcggaactcgcataaaaaccctagtttgacttgtgaggaggcctgctatctcgcaataagcctggggtcggcacaacaccgatcccgttgatatcgagaaattgggtatgattgcacctgaagtgcctgtatcggctgacttgattacccgtgtcaagtaaactaccacctggattgtcagcctgccccctgaagggatcgccgctgttaacatccttatatgtaatagggtgtgatttaaagtctcctacttggcgatcccctagttaagaatatgcacgattgattggttagcactgtagtatcaatccatgctgacggtgaacagatgagtgcattgcttatgatttgaggagagaaatggcaaagtgcatacacagttgcctccaatctaggggtgtctcaacgaattactatcaggctattgggtctagtaaatatgaataccactgctcctatacccggttgtccccctttccttcttctgggatgcgccacaaaggttattcaatgtgatacagtaggctaatcttcttagtcaattgtgtttcgaattacaatacgtgatacgccctattacaccttccagcatccgtctgagactagaccagtatagtgtaaccacaccttagggactaacaggagtcattccttggacgaaaactgaaggccagcgtctggtgatattggttgggagccttatccgccaagtaagtgctgatctcctccaccaaggacttggtcaacaggtgacaatgcacattaccttctttcatttttacaagatccctaacgcgactgatgttccagaccagaagctcaattagccattccagcaagggagaaaccaaagcttgctagaccaaccttatctcatcatcttgaaactcgttggaagagagcctccgttgacatacaaccgtccaaaaaacatggctgaaaccactaagaaaatgccgatcgctatatgtggagcggggatacgatccactggccccattccattgtttaaagaatccacggattcacttgcgaatcagacagaggcggccgggcgtcatggcgccaccagtgagacttgtgacaccaaaggtgagtccacccccggtaacgccggcggctattttgacctcttttcaaatcagggctctaatcttgattaagtagaagttgcaggcctccatgtcctttctgatgtggtacaggactgcttagaagatgcatgtgagacagctttcactgatgaagatgcttatgttggtatttttctgggaaattcgggtgccgaaggacaaggtgactctgaaaatgaggtcaaaattgctaagaacctgggaagtagcattggtctacatggaccctggtaagcttctccaaccgcccgatgatggtcgtactctaacgcgatatcagtgtgaccattggctctggtccatcggcggcgttcattgctttgcatgaagcgtgctatgcaattgcatctggaatagcggactctgctgtggtcgtttgcattgaatcgtcatcggatacaacggcaggccagggagagttcgcagctgtctatgtcaagccattggatgctgctctgagggacgagaatcctgtacgagcactcatacgggccattgagacggattactacagttctgctcacgaagatgaagtcagtccggaactggcgtatggttcaatcgtccgcagagcgtatcagaaagcaggcttgaatcccattgatacaaccgcagtggaggtgagtcatcaattcttcaccaccatctttttagtcctgtggcggtaactactataatattgcttctctttgttactaattagctttagactactggacatatgcgtccattggtcagtgaagccgaaagaatatctatcaacaacgtattcgacgtgcgacacgtcaatatcaattcgatcaagccgcaaagtggcagtggacgaaatgcggcaggaatggcgaatttgctcaacaccatgctttgggtggaagacagggagtcttcctcgcccgcatatccaagttctcaagaccaaaatggaagggtcagcatcaactgtttcgatgcccgagggtccaatgttcatgtatgtctattgcccgaccttaagcatttatttactcatgcatgaaagataattattgatccgcctcccgtggccgatcaagaaccacaaagacgaacggatccgcaactcattctcttctctgggccatcgtcccgttcactagcaaggcagatcgaatcgtataagaattactgtctggctcacagcagtcggacggtcgacgtcgcttatacaagagcaatacgccgtaaagcgttggatcacagggcattctctattgtctgccaaggaaaatttatcagcacttcgaaccatgtcaaattgccctccggtcctccacaggttactctcatattcaccggccaaggtgcacaatgggctggtatgggtgttgaacttattgaagcatacccaaatatcaagggagatcttgagatgatggataacattttgagtgggctagtacagcccccatcttggagcattttaggtgaccgaagagcccattcttctggtttaaacacacaatgttggctaatgactgttatttttgctagatgaaaccacaaggagctccagtgaccccaaaaatcgcgtcaatcacgctgaacttgccccaacactatgtacagccttacaaattgccttattgcggcaatatgagcgactagagattccggtggaagctgtcgttgggcactcgagtggtgaggttgctgctgcctatgccgctggctatttgagtctacgtgatgccattgttgtggcttatcactacgggaaaatggctacagcccgtactaaacgcggcggtatggcaactgtaagcttggatgctgaggcaacccgcccttttcttcgtgagggtgttgtcgttggttgtgagaacagccctgggagttcaactctttcgggtgatctagaaacattgaagaaggttctggctacaatcgaaaacgcaaggcctgatgcaactactcgcatggtgaagacagagatggcttatcactccggtacgtatatgtcctactcttgataatagctctacggaccggacagcctttctaattctaccttagatcagatgcgcgaggtaactgggatattcttgcaggggatgcttgaagacgatgttaagtcttcccggccaaggaaggagcaaaaagcggcatattactcatccacgtacggaagaaggctgagtaaagatgaggaccttggaccggagtactgggtcaagaacgtgacccagccagttcatttcagttctgctgttgcatgtctctttgaggcttcgtctagaaaccagttccttcttgaagttggacctcattcaactcttgctgtgcctcttcgacagatctgtgacgcgaagcacgtaagcttcaactatgtctcgtcacagacaaggagcaaagataacatagcgcgattcgtgatctcacttgggagactatggcaagaaggtgtaccattcgacttgcggtccgtgtttcctggtgggaagcccattgcaggtctcccagtcatcccccgagatgacgacgagatttcgggggagctaatggaagatgacgactcctcccccgatatttcgattttcgattcaacgacactttcagcaaaagaaaaaagagatctcattgtgtaccgctcgctacaaacggctcattcaataccagacgaggaggttccgaccacagagatcgagcttattcttagggcaatctggaccaaggttcttcaagggataacctccataagcccacaaaagattggcaagagcgataatttcttcttgttaggaggtgactccctcgtgattatcgaaatggtcaaagtcgcttatgagattggacttcgacttgcacccgcagaagcagtgcaacaccccaggctttcagatatggctggcattgccacgatcagcgacgatggcactccactagtgagcgagcgctttagcatggttgcttcacaagttcaaggtacatccagtatcattgaaaaagccaggcaagcttgctccctctctgatcaggggtgtatcgaagacatatatccttgtactgctctacaagagggattcatggctctagcagtaactcagccgggctcttacgtccatcgttgggtatacaagctttctggatccgttgaggttgcacgcttccaagctgcatggaacttgataatacagaggtgtaccaccttgcgctccagaatctgcagcatagatgacaaggccctccaagttgtggttcaagacgatacctcttgggaacatccaccttcgggcctagatgtacatgcttatgtcaatcatgctcggtccatcagaatggcctacggcgatcgtctgagccggtatgctctcgtgcatcaagacgacggcgctgtctactttgtttggatcctccaccatgctgcttttgatggcctcacgatgaagctggtgttagacggcctgtacaatgcttactacgatagccaaggcattgggctcacgttgccttacgccaactttattcaatatgttgagtctttggatgtagaatcagcgagagactactggcgtggacaacttgagggcgcaaaaccagcattgttccctactgctcgaccaaccaccaattccaaaatgtcagggcgggtcaagaagctaaccatgcccttccacaatgcaacgaggccggccttcaccacagctacgatcctccgtgctgcatgggccttggtactagcaaaatactgcgacacagatgatgtgtgttttggcaccaccgtttctggaagacaagccccggttccaggattaggtgacatacctggcccaatgattgctacggttccagttcgtgttcgtcttgtaaaagaccagaagatttcgagcttcctccaggacattcaagcccaagccaccgggatggttccatttgaacaacttggcttacagaatattgcaaagctcagccaagacgccaaggaagcttgcaatttctcgaacttatttgtcatacaacccttaaatcacctttcgtctgctgcgctagaagctaccgatgctattctttaccaaagcaaagaggagatgagtctttccgaagaggctatgaataattatttcacctatccactagtcatccagccacgtattggcaagggctacatagaaatagacttcacttactacgctgatatcgttccggagaagcaacttgaagcggtgtaccatcatctaaaacacgttattaatcagctgctcgctcccgaagacaggaccttacgcgacatctccgtgtcaggcccatgggacatagcttattcacgtggagctaatattagagatgttcgcatcgttgatgaatgctttcaccatctcgttgagaggcaggcaaagctccgaagtgcagagcctgccatcgatgcatgggacttgaagctgacatacggagagctgaatgatgcagcaaacaggctgtcgcgacacctcgtgaagagcttaggggtcagaccaaacgacttggttcatgtgtgctttgagaagtcggcatggtactacgttgctatcctcgcggtgaacaaagcgggcgcagcctgggttcctctcgacccatctcatcccgttcaacgtctacaacaggtcgtgtctcagacgcaggccaggttagccctatcatcctatgaaaccaagcctctctgctctttgctcctggatagagtgctggaggtgggtcatggcctcctcgacgacctcaaggacagtgagtcaaacgaggatggagttgtgaatgtatctcccgaacaggccgcttatgtcttattcacatcgggaagcacgggcatcccgaaaggtttcgtcatggaacataaggctgtgtgcaccagtcagacagagggatcaacgaggctgggaatgacatcaaaaactagaatgctgcaatttgctgcctatgtttttgacttctcgattggagagattgtcggacctctcattgttggtggttgcctctgtgtgccttctgaacatgatcgaacgaatcgtttagctgagtttgtgagtgaaaagtcggccaattggatgtattcgactcctgcatttctccgaacgctaagtccgcaagacctcccgagtatggaattgataatgcttgggggagagtctgttggacaggatatactcgacacgtggtttgggaaggtgaggctgctcaatgcatggggccctggtgagacttgtgttttcaacacatttcatgaatgggcttctaccagagagtccccgaggtgcattggtcatcccatggctgccaatatttggattgtcgatcccgaagacccgcagaaactggccccaatcgggacttctggtgaggctgtgatccaaggaccaacacttctcagggagtatcttggaaatagaacccagacggaatcgactatccttcgcacattgcccacttgggcgacacaccagggactgcctgtttggggtagaatgtataagactggagacctttgttcctatgacttcaacgggaccatggaattcataagccgaaaagacacgcaggttaagattcgaggcatgagggttgagcttgaagaaatcgaaaaccaaatccgggcacaactacctagtgtctatcaagttgtcgtcgatgttctcaagtctaatgcaagcactgttctggttgcatatttgtgcttcagtgatgaaagaagaacagggaatgttgttccagaggaaatatttcatccgccatcagcagaggatcaaattcgcattgccactttattaggccaactgggctccaatctgccacaatacatgattcctactcacattctccattgtcggttcatgccttccactagctcaacaaagctggacaggagaaagttagggcaactaactgccaccctgaccagtgatatgcttaatgcctattcacgtcttaactctgagaagcgcgccccggagacgagtatggaaactcgcctccactcaatctgggcccaagtcctgcaattgccaccggaatctattggaagagacgatagctttctgcggataggcggtgactcgatctctgtcatcaaactgatcagcatttgtcgtcaaaacggaattattctatccacgaaagatgtcttcgacaacccaaccctcctgtcggtggctgccaaagcagttgaatccaatgacagtgtcccaaatcagggaactgaatcacaatatggcctccttaatcagaatataatcaagcagctgcaggatcagagcattagagagcggctcgggctgtccagcgagcagattatcgaagatgccttcccatgctcgccgatgcaggaagggttgatggcacttacggctaagctaccgggatcctatgtttgcaagtacgtttaccgaatacccgagtatactgacattgaaaaagtgaaatatgcatgggacaaggcgcttcagatatgtagtaacttccgttcccgattcgtcatgatcgatggccagacaatccagctcgtcatcaaggagcgtaccctctgggagcacagcatcgctcccgatcccgagacatatattcgccagaaagactacaccgactttggatacggagcctcgctttcgagatacacgattctgtcgtgcggtggtgataaatactttgtctggactgcccatcatgcactctatgacggttggtcactgcgcgtaataaccgataatttcgaaaggatatacaccggccaggctgtggaagatctaaccccatactcagccttcatcaagtacatcgtggacctcgactccgataaatgcagggaatactgggccattaagctagctgggagcacaaaaatgtcattcccttctcttccacacaatcctgcagcgaacaaggaaagattgccccagtactttcgtcatgatattgacctgaaggggaacaagcactcttcaatcacgagcgctacaataatccgtgctgcttgggctgtggttcttgcaagctacagcaactctgatgatatctgctttggagtcaccgtgtcgggacggcaggccccggtttatggaatcgaaaacatgtcagggcccggtattgccactgtccccgtccgcctccgtctggaccgcaactccagcgtggctcaatttcttcaggcaacccaggaggatgctgttgaaactattccattcgaacagtttggcctgcagaagatctcaagggccagcgatgatgcaagagtggcagttgacttctccactctgcttgttattcaacctactatcaagaatagtgacaaagaatctggcggccactcaattcttgttgcaggcagcactgaacaagagatggtgcaagagacattgggcgactactttaattatcccttggtgcttgtcagcaatgtctatgatgaccatttctatcagcgtttattctatgatggcaacatcatatcgaaagatcaagtagtggcaatgtccaaccaccttgaacacgtcattcaacaacttttggtcaaggtggaagagccactcgggagcgtgtccttagtcagtcagtgggacatgcagcatgccatcgactctcagcgtctctgctcaccggtcgactcatgcacgcactggcttatacaagaccagatcaagaaccatccggatgatatagcggttgctgcctgggaccaggatttgacatatggtgatcttggagtctatgcttctcgattagcactgaagctgcaagaactcggtgtcgggcctgagactctagttcctttctgttatccgaaatcagcgtgggctgttgtcgcaatggtggcaatccagatggccggcggtgcctttgttccacttgatccagctgcgccaactgcaaggctccagtccattatcgacggaactgatggcaaactagttattacgtctccgacactagaaggaaaattgcgtgatctacagacaaggacgttggttgtcgatgaggcatccttgagagacctccccgatgccgtccgaccggtttcatcttccaccaaaccaaacaatgccagttttgtcatctttacatccggctcaacaggaaagccaaagggaatcctcatccaacatgatcaaatttgcactggattcatgaactcgtatggtcatgaactgaaccttggacgtcatagtcgtgttttcaacttttgcgcattcacattcgaccttggcatttttgatgtgattggaacattaagcaggggtgggtgcgtctgcatgccctccgaagaagcaagactcaacgacctagccggtgcaataagggcattcagggcaaattggctgttctgcaccccgacagttctaaacctaatgcacccagaagacgtgccactaataaagactgttggactaggtggcgaggccattacgaagacgatttcagatcgctggaaggaccatgtacagcttaacgggctatacggtcctgctgaaggttcttcatgtgctcgtaatcccgacgtcgggagagatgataaaccaactaacatcggaattccaatgtccagcgcattctgggtagtcaacccagacaacatgaaggagcttgtgccggttggtggtataggcgagcttctaatccaaggacctatgctagcccgagggtacattaatgtctcgcccgagcagaatgcagtttggatagaggaaattgactggctacctggtgaagcatcacgccgcaaaggatatcttactggcgatctggtgcgtcgaaatgctgatggaacttgcgaatatttgggccgcaaagacacgcaagtgaagattcacggccagagagtggaacttggggaaatcgaggcacaaatccatcagtacttgccaaatgaaatgagtgcagttgtcgatattgtgaagagtgagcaagcgtccacagagaatttgacggccttgatgtggtacaacaagtcctccgatgagatcactcaaggcccgttgaggttgcttgaagacgttactgatggagtaaagtctcttatatccttactaaacgagtcgctgcaatcagtcttgccatcatatatgattccctcaacctatctggtattccagggcaaaccggatatgtctacctctgggaaagttgatagaaaggttcttctgtcccacgcaatgactatatcagcgcaggatcggctttgcttcgaactcgagactcacgaaaaaaggcctcccacaacccatatggaactcaagctgaggtacctatgggcccaaattctgtccattgaagtctcggaaattgggaaatacgatagcttcctgaggttgggtggtgattccatcagcgcgatccagttagtcactctggctcgcgatcacaacattggcctgagcgttgctctgattttcagcgagccccagctgttttcaatggcagaaggggcagaatatggtttggacgactcaaaactcgacacaacgccttttaggatgatttccgaggcccagaagagccgcattctttccatatgccgcgatgagcacagactcaacagcaatgctattgaggatgcctacccaagtacaaagctacaagagggacttatggctctctctgtaaaacaacccggctcgtacattgctacccatatgtaccgactatcacctgatgttgatgttggacgtctgcaacacgctatagaaaggactgttgaattttgctccaacttgcgaacgagaatcatcgatgccgatggacaagccttccaagttgtatttaaggatgagctttcgtgggaagtgttgtctaaggatacagagcctcagcgattagccacgtcaaaaagtatcagtatgacatatggctctcagctcaaccatttcacggtcttcaataatactgaagggaccaaatacctgatgtggcgaagccatcatacgacttttgacggctggaccatcgggatcatcctcgattgcatcgacagtatttacaatgaaaagaagccaccaaatgtcatcccttattctgcgttcgtgtcctacaccctagacgtcgatatcgctgctgctgaggccttttgggccgagcagttacgcgatgctcacaaaacacctttcccttcgccacaacttgcagcatccggggaaactaagatgtatacgaaatttgtcacgttgccaaaatcagaaggctcgtccatcacccaagccactatcatccgggcagcgtgggccattctccttgccaggtacagcgggactgatgatgtatgctatggtgctgctgtgtcaggtcgtaacgctgcgatccaaggcgttgaagatatttccggtgtcatggttgccactgtccctgtccatatcttgattgatggatctaaaacggttgaaaagttcctcgaagaaattcagctccaagcgtctaatatgattgagtatgagcagttcggcttacagaacattgccgcaatcaatgacgagtgtaaagaggcatgcgacgtatccagcttagtcgccatccaaacaagcaaacagtccggaatgttttccggcaatgggcttttgaccccaatgggactaaaggacgacgttgttgagagctctcttcaaggatacctgacttacaccctcgttatggaaggtacgttggtggacggcggcattgagctagtatttatccatgacacgggtgttctgaagccgattcaaattgaagccatggctcaccagctcgagaaggttatcttggagctacgaaccgataactccaagctcctcaaggacgtctccatgacctctgattgggatgtcgaagtcgctttagcccgaaaccctctgcctcgggccattaatacttgtgtccagtacgtttttgaagagaaagtgaacattcacccagacgctccagcagtttattcctgggacggggagctgtcatataaggagctcaatactctcgcgaacaacctcgcttcacatctcctagatgaattgaaggtcaaagtgggcgacattatacatgtttgttttgacaagtcggcttggtattgtgttgttattttagctattcacaaagccggtgcttccttctctcccatcgacccagctcacccagtcaaaaggaaacaggaaataacaaatcagacaaagtcaaaactcatgctagtctcgccgaatcatttgccaatttctcagggccttgtggaagacgttgtgccaatagacaaacagtttctgctcgacttgaaacataaccccgagaatccacagacaactgttggccctgacaatatcgcatacatcatgttcacttcaggcagtactggaacacctaaaggttacgtgatagagcatagggctctcgcatcggggcaacaagatcttgccaagcgcctgcgcattggatctgaggctcgtatactccaatttggtaacttcatctttgacttctccgtcggcgagatctggcaggcatgggtgaacggtggttgcatatgtctgccatccgaggaaatgaggcttaataacatgcaggagtttatgaacatggctcaggtcaacggggccttattcactcctaccttcgccagcacgatcaaacccgaggaagtaccatctctcaagtggcttctaatcggaggagagactgtgcaaagagatgtgtatgagagctggttcggaaaggtgcgattgataggggcatggggaccaagtgagacgtgcttcatcagttcaacgcacgagtacacgtctctagaagactctccttctactataggagatcctattgctgcttacaattggcttgttacccccgaagacccacgagttctagcacccatcggcacagttggtgaaatcctggttcagggcccaactgtatttcgagaatatctcggagatccagagaaaacacaggcatgcagggttgagaacgtgcctccgtgggcattcgaacgcgatgacgtctcattcaaccgttcttataggagtggagatctggcgttctataacgctcagggcaagatggaattcgtcagtcgtaaagacacccaagtcaagattcgcggcctgcgtgtggaattgtccgaggtcgagcatcatattcaatcactattggaggaagcagagcaagtcgctgttgatgtgtacaggcccgacggagctgtccatcttgttgcctattttgccttttctgaggacacaaaattcgtcagggccgacgatgcacttgcatccgacatgttcttaccagtcgtgccagaacttgagcataagattttggaattagttggaaagctaaagactattctcccaggatatatggtcccatctatcttcatcccatgtgggtatatgcccatgggaggcacttcaaagctcgatcgtaaagctctccaaaggtctctctcgtctcttacgcaagatcagttggcgcattactcacttgtcaattccgtgaaacgagccccccggacaccaatagaaagccgcatgcaagagctttgggcctcgcttctcaaaatttcccccgattccattggaattgatgatagtttcttacaaattggcggcgactctatcagagcaatccagctggttgctaaggctcgaggacttggactaggacttactgtgaaagacatctttgatgatcctcgtctccatgcagtagcttcttgtaccattgagctcggaacaacacacaaacaaacaaatgaaataattcagccatttagtttgctgtcccagagattgcgtggtgttgattgggagagcgaagccagagatttgtgtggtcttggtcccgaccaacttatcgaaaacgctatgcccgtgaccgcatttcaggagggattaatagcacttactgtaaagcagccaggttcacatatcggaaagtttctttacaggttagcccccaacgtggatgtgaatcggttccgaaacgcttggggaagaacggtttgcttgtgtcgaaacttacgtacccgcattgtcaacacctctcagcagacactacagctagttgtgtcaaacgatggctcttgggaggatactacaaatatcagtttgaaagattacatgagacaaaagctcaatatgtcttatggttcccgtttgaacagatgggcattgtttgaggagtccagcggtgagactttctttagttttactgcgcatcacgcaatttacgacggctggtcagttcagcttgtgcttcaaactctagctgaatcatacaaccaaacaaaccaccacgaggtcaaaccgtttgatgctttcatcaactacactgaaggcttagacaacgaggctgcacggcagttttggctcaaggagcttaaagacgcttcagctgcaagttttccacctcgaagacaaaatttcgagaacgctgaaacaagagttttgaaccacgaatttaagttgcctatgtcttcacacgcttccataactcaagccaccattatacgagcagcatgggccttgcttctggcccaatactgtggcacagagagcgtctgtttcggaacatctgtttctggccgtcaagcacctgttgctggaattggtgagctggcgggccctgttgtaactaccatgcccgtccatattctcatcgacccccatagttccaccctggaattcctgcaagcggtgcaagcgcaagctaccgagatgattgcctatgaacagtttgggttgcataatattctcaagcttggggactcaattcgtgatgcctgcagcttttccagcctgttggttgttcaaccacgtgagaaaatggctgagactggccgtgaagcggaaaagatacttatacctatggtcaatgatgaaaataacgacacgaacatccaagggtatttcaactatccattaatcgtacaggcttttgtttcttcctcggaggttcaccttaatatcactttctattctgaagacatcagcaccttccaagttgagggtctcatgagtcaactcgaacacattatcaaaacactttccgtcgagggtagcaagccaattcgacagctagaaacggcgagtgcttgggatctccaacatgctcagagcctcaacaacgagatcccagaggtgattaactctacattccatgagttagttgagaagcaggctagggcaaggcccgatgccatcgctatacaagcctgggatgctactttgacatatggcgagttcgatatgtatgccgactacctggctcgatacttaattgttgagctcggtgtacaaagaggagatctcgttcacgtgtgctttgagaagtcagcattccatttgatctccattttggctatcaacaaagctggtgccggatgggtgcctcttgacccatctcatccctttccacgactacagcatctcgtttctcagaccaaggctaagcttatcctcacatcagctaaacaggctgaactaagtaatgcgctattgttagaggttctccaagtttcgcgtgcttttgtcgataaattggtcgaagaatacacaaccactaggtcagcaaccaatttgatagacaataaggctgagtcctccgatgtttgctacgtgcttttcacatctggaagtactggcacaccgaaagggttggtaatggaacacggcgctctatgtacgagccagattgccgttgtgcgaagactgggtttcaatccaaatgtcaaaatgctccagttcgcttcctatgtatttgatatgtccgtcggcgagatcgtcggccccttgatttctggcgccacactctgtgtgccatctgatgatgtccgtcttggtggcgtagccgatttcattcgcgagaacaacgttacatgggcctacttcacgccatcgtttgttcgtaccttgactcctgagtctgtgccctcgcttgagctacttgccctggcaggagaggcaatcccaagagatgtttttgagaaatggatcgtgaccaatgtccgttttatcaatggttgggggcccgcagaaacatgtgtctttagcactttacatgaattcaaatctatcgacgaatctccgcagacattgggtaggccagttggtggtttctcttgggtggtacagcccgacgatccttacaagcttgcgtcggtgggaaccctaggcgaagttgttgtccagagcccgacactgctgcgtgaatatctatcagatccggaacgaacagagaagtcgacagttcggaatgttccacaatgggatcatcgtgcggacccatggagtcgcggatttcgtaccggtgacctttgtttcatcaatggaagcgggctccttgaattcgctagccgtaaggacactcaagtcaaagtccgtggagctcgagtcgaactgggagaagttgaaaatgcgattcaatcacatctctctagtctgcgtcgagtagcagttgacattattcctactcctgctggggtgactcttgctgccttcctgtgcttcaccgatgatgacaacgtagtaaaactgccaaatgatggtcggttcctaccaatgagtaaggacatcggtgaccaggtggcggacatgcttaccaaactgaagggagcccttccactctacatggttcctaggttgttcattccctgcagctatatgcctttcatcacatcctcgaaactcgatagaaagacgctcattgctgaggcctcaagcctagatcaagatcaaattgttgcatattctcttcaaaatgcagaaaagcgaccgcctgtcacagatatggagatcaggctgcagaaactctgggcagacgtgcttcacatctctcccaatgcagttggtcgcgacgacagtttctttgcaattggtggtgattcaattgctgctatccatctcatgactgcgtctcgaaaagaaggtgtgaccatccgtgctgatgacgttttccgttacccccagctcttccagctcgcccttcgagcaagcaaagtgactggctcggaatcaaccgagcttcatctcgaaccatttcagcttctaacgactactgagcgagacctggtgctaggggatgcgctatctgagcttggcttagcgaaggaatgctctgttgaggatgctttcccatgttctcctctccaggagggattaatctctctctccgtaaaacaagccgggtcctacattgcaaagtatttccttgagattccagaccacatcgacatcgaaagatttaaatctgcttggaaaaaaaccgttgacctaaatgggaatttgaggaccagaattatagatacaggcaaccgtcctattcaagtgttgctgaaagaagacttgcgctgggagccttcgcagagactaagcctcgaagagttcgtcaacgtcactcagggctatactatgaccttaggaacttcactcaatcgctacgcgatcgtatcagatgccccatctggcaaaaccttctttgtatggatctttcatcattctatctcggatgggtgggcactacagttggcctttaggacactatttgagtgctactggggaaatttgtccagccaattatacccgtatgccaattttataaagcatactctggatctcgactgggatgcggctgccagcttctggggcaagcagcttgaaggtgcaaccagcttgcctttcccaccgcccagcctcaaaaacaagaagccagtcttcaagtttgctcatcacaaggtgcaaatgccagcacgactaggtacttctgcaactctcgcaacagtgcttagagcagcatgggccatagtcctagcgaggcattgcaataccaacgatgtgtgttttggtgcaacagtatccggccgaaacgcctctctcaccgggctccaggatatgcctggtcctacaatcgctaccataccagttcgaatccggctcgataattccaatgacgtggaaagcctccttcaagctgtgcagaatcacgctaccgagatgacagcgtatgaacaattcggcatccagaacattgcaaaagtaagcaacgatgcacgaaatgcatgccagttctctaatcttttggttattcggccacaatcccatatccaagggaataacgagcatgactccgtcctcaagtttgtcgaaggaaatgagatgactgagaaagagagtgtcaactatttcacctatcctcttatttttggcctagacttattttccgaccacattgggataagtttaagttatgacaacaatgttctatccacagaccttgtcaacgcgatcattcaccagtgggagtttgttgttcagcagcttttcacgaaaccctcagagactgtgcgcaacatctctcttaccagcccttgggatattgaacatgcccttcgctaccagaacatgtattctccaattgaaaggtgcattcacgacttgattcgcgaacagataatgctaagacctgattcacaggccttggtatcttgggatggcgaaatgtcctacaaagaaatgggctacttttctgagaggctggcgaacaagttgcgtcatctgggtgttaagcctggagtcttcatcccagtgtgcttccctaagtctatctgggctgtcatctcgatgattgcgatcagtatggctggtggtgcgtttgttccgctcgattacaagtcgccagcatctcgcttgaaagaaatcatcagcgatactaattcgacactggtacttgctgatccaacctgccttgacctagttgggcagcttggaattgattttgtcattgtgaacaaggattacatcctcaagtcgtcagaggtagccgagattgatccctcctccattcctcctgttaagccgaccgaccccagtattgtcctatttacctctgggtctactggaaaaccaaagggaattgttttcgagcatcgcaacacttgctcgacggcgaaatggcacgccgatacgctgggctggggaccagacacacgtgtcttcacgtattccgcatacacgtttgatatgggaatattggagatactgatgtctctttctcgtggcgcatgcctttgtattccgtcagaatggcagcgatacaatgacatccacggggctatcaactccacccgagcgaattgggctttcttcaccccaaccctggctggactcctaaatcctagtgagataccgacagtaaagggagttggacttggcggcgagaaagtaacacagaaagctattgaccaatggaaagaccacgccaaaatctacgctatttacggaccagcagagacatccaactgtaacgagatgaaagaaatcggaactcccccacggcccaataatattggtggcccctcgtcaggtgcttggtgggctgtgaatcccgataactacagggagctcgtcccggtcgggtgtattggtgagctaatgattcaaggaccgatgatggcacgagggtatatcagtgccagcgaagtggcgaacaatgcctggctctacgatgttgactggcttcctggaagtggtttccctaggaaggcttaccttactggtgaccttgtccgccgactggaagacggaactttctactatcttgggcgcaaagatacgcaaatcaaactccatggacagcgtgtcgagctgagtgagattgagactcgcgtggaacagaaattaccttcagatatgagctgtgtcgtcgattgtattatcaatgaggagactgaaacagatacattggcggttctgctgtggtacacgagtgggaattatgctcaagatcccaacttcaggttgattgacgagataccaaacgagatatatgacttgattgcaagtttcgactcttcgttgggagcagaactacccgcctatatggtccctggaatgtaccttgtgtttcagggcacccctgagaggaacagatcaggcaaagttgacaggagaaagcttcgcgcaatcgcaaacgctgtcccagttactcaaagactcaagttttccagcagcgctcaaagcacagaaaaaccagagaccgaacttgagatcacactatctcggctctgggctcaagtactgcctattgacgccaatgatattggccgacatgagagtttcctaagagctgggggcgactccatcagtgcgatcagattgagcactctggcgcgtgaacaacgtctttcacttgatgttgcaaccattttccgagacccgcggctttctgccatggccagcgcagcggcgccaattgtggacgaaatcaatggtgctcccagtgccttcagtttgatttcggatattccccaaaatgaaactattcatgaagtggcgagcaaatgtggattctacaatgtcactcaagtagaggacgttctcccttgcacccccttgcaatctggtcttatggctttgacagtgaagcagccaagatcatatattgcccagaacgcctttcagctttcaagcacggtagatatctctgtcttcaagcatgcttgggcccggactgccgagatgtgtcccactctacgaacaagaatcgtccaggtccagggcaagacgctccaggcagtcttcaaggatgacttcacgtgggaagatttgtctgctgatacaaacatacctgtttacttggctgatgtaaccatgtcgtacggagatcgactaaatcgatttttcctctacagggacgaaacagggactctcaatttcatgtggctagcgcaccacacagtattcgacgggtggacagtgcaactgattatgagagtgttcaaccacatctaccattacacggaagtaccgcgattaaccccttactcgacattcattgcatattctatgaagatcagtgaatccgcaaacaaagctttctgggaggaggagctccgcggtgctcaaagggctccgttcccatcagcctccaagagcgtttcatccattacagaggtcctccagaaaacattgtcattcccagggctaaagagcaggtcggtcacaagcgctacaatactccgtgctgcctgggctctgcttctcaatcggtactgtggatctgaggacatcactttcgcagctaccgtgtctggccgtaacgcgccagttgccgggatagatcaaatacctggaacaatgatcgcaaccatccccgttcgcatcaaacttgataatcagaaaactgttcataccttcttggaggacgtgcaaacgcaggcatttggcatggccgcctatgagcagtacggtatacaaaacatctccaaagtcagcgatgatgccaagcaagcttgtgagttttctagtctcacagtgattcaaccttcgcagcaatacgagtaccaaaagaatgagacgatccttcttccctcaaagggtgatcaggattctgttcagtcctcgctcgcgggatattttacctatccccttgtcatgcaatgtctgctggccggcgacgaatttgagctatgtttgatttacgacgctggggttctggagagatcccggattgaagctatgtcatatcaattcgagaagcttgtttcggaactcctttctgatgatcgcgacaagcggctagaaaatgtctcaatggtgtcttcttgggatgttgagacagctatcagccggaatcctgtacctaaagttattgaggtccccatgcctaatgtgatagccaactttgcaaagagccagccgggcgcggcagcggttcatgcctgggatggagattttacctacgctgagctcaatgataccgcaaaccgtctcgcaggaatcttggtgagacagtatcatgttgaagttggcgacgtcgttcacgtctgcatgagcaaatccaaatggtatccaatctcaatactagcaatcaacaaggctcgcgctgccttctcgcccatcgatccggagtacccctttgagcggaagcagaatatcgtacaacagacgggttcaagactcgtgttgatttccccagaccaatccgaatgctattcgaaactggtcgaggatacagtcgaagtcactgatgatttcttctccagtcttgaagggtcacttgacgggccccaactcgaaataaaaccagaagatatagcgtacgttctcttcacttcgggaagtacaggcactccgaaagggttcgtaatggaacacggctctttgtcctcggcccagcatgggatctcagaacgtattcgcttcaagcctggggatcgagtgcttcaattcgccaatttcgcctttgacttctcgatcggtgaactcttccaagggctgtacagtggagcatgcatatgtattccctccgacgaaatgaggctcaacaatgttcaaaaattcatacgagacgccaaggtgaactgtgctctcgtcagcccagcatttgctcgcaccatccgaccagagcaagtcccctctctcaaaactctcggtctgggtggcgaaactgtaccacaggatcttctggaccaatggcacggaagagtacgcctgataaacttttgggggcccggagaaacctgtttcgccagtagtatccatgagtataagagttctgatgaagggccagcaacaattgggtatccggttagttcccgctgctggatcgtcgaccctaccaacccgagagaactggctcccatcggcactgtaggtgaggttttgattcaaggcccaaccatcattcgtgaatatctcaacgatgtcaaaaaaacgagagcttcggttgttgaagacctaccctcttgggcaatgacaggtccaggatctcgcttcaagcgcgctttcctgtccggcgacctggcgtcgtataatccagaccgcacaatgcattttgtcagccgaaaggatacccaggtcaaaatcagaggtctccgcgttgagctgggagagatagaacaccacatactgtcagacctcggtggagtttcacaggtagctgttgatgtactgcggagcgcagaagcgacaaacatagttgcctacttctccttttctgacgcaagacggactggcacaagtgatctggaatctatgttccagacaatctcatctgacctcaaacttcaacttctagaattgctaggcaagctcaggcttcatctccctgcctacatggtcccctcaatcttcataccatgcgagttcatgcccatcagcgcctcatcaaagcttaatcgaaaagcgctgcaagaacagaccgccaagttgtctgtagagcagctacatcactactcgctaaccaacaccgagaagcgagcaccagaaacccccatggaatttcgtatccaggccctgtgggcatcaatcttgggcttatctgcagagtcaattggccgcgacgacaacttcttgcagctcgggggcgattcaatcacagccattcacctcgtggcagcagctcgtgaggtcgggattgaactcacagtaatacagatcttcgaagatcccaggctttccactgtagcatctcgggcaatcgagttacttgcaaacgaagacgacgatgaagagcggcaattagaaccgtttgatttagttcccgccgatctgcaagacctggactgggacatggaagttggggatatttgcgacctctcagggagtcaagtaatcgagaacgcgatgcccgcaacatccactcaagagcatctcatggcattgtccaacgacaacccagaacctttcatctccaggcggatatataagctatccgaggaggtcaacatcaaaaggttccgtaatgcatgggtcaagactgtggggtcctgccccatcctacgaacgcgcatcgtcgaagtctctggaactacaatgcaagttgttgtggcttttgatgttgcttgggaagtcaccaaaaacatggatttggaggattacaccagccaagccgatgatatggagatgtcctatggttcaagattgaatcgctgggcgttgatacagcagccttctggggaatcactattcgttctgacttcccaccaggccacccatgatgagtggacgatacgtctcatactgagaacactttcccatcattatgatcgaagtaaagtccccagcgtccgagatttcgggtacttcattcaacaccttgagactcaagaccttgaggctgcccggaaatactggcagaaccagctaaaaggcgccaaagccgctgcgttcccatctctaagtcagggcttgtcaaagggcgttggcagaataaccagatctgttgatctccccaagccgtacaaaacttggatatcccccataacattggcaagatcttcgtgggcgctgctgcttgctcaccactgcggcacggatgatatctgttttggtacatctttcactggacgagatgctcctgtttcagacattcgtgacatcaccgggccggtttctactattttgccattccgtctacgtattgatcgcagcgcgtctgttagtaccttccttgaactcgtgcaaaagcaagctgcggagatgatcccgtatcagcacttcggcctcccagatatattgaagcttggggacgatagccaagatgctgctacattctccagcatattcaaggtcgagtcatccagcgaactggctgatatatatgatgggtcggacgtgatgtcgtctgtcgccgaagaggatggccccgttgagacactagaatccttcggccagccattggtagttgaaagcctcgtttcttcctcaactattcgctttaccatgcatttcaactcaacccatttgagttctacacaagaagaggagcttgcaagtcagcttgaacaagccatccagttcatggctaccgatgcttccaagacattagggcaattcgcagcaaacccactgaggtcaacggctcttagagaaccaaatgggcatcagcgcaatgggggcatatagctgcgtggagtcctaaagacaatatgatcatgaagtgcttgattactaggagaccagcgtcgtagagctatagtagtacgacaagaaggcggagagaatgagaggggaaaactgcatgtattttatttattttttagttatttgagtaattcaagaacttataccttcacaagcccacttgctgtagaatgttcttaatccctcttatgctggatgggctgctagtatcttcatggggtctgagctgagggtagcgatgaaatggcagatgggcgatgatgggacagggcgagtgatagccgaatagctaacgaggactagtaaagcggaagtaaagcacgtttgttattattgtttacatttagtaaataagcagtactttagttaagcgaacgcggatgatgccatccctatccctgtaccggcaccgaagacgcgtacgaaagcaatgaattgaacaagtgccgattcggtagttaacaaaaacctttcggcaggcactcttgttagaagtcgcgcaatgggatagtaggtatggatttatttcacaaaattgatatcctgtcctgctatactgatgctttgaagaaatcgtagccgtccaaccgtcttgacggtgattgttatagtggagcattccaacgcatgtgagattgcgcgtgaaagccgaggcaagacggacagcttctgggtggagacttgagcgtgttccagcgcgtctgaagatcgtcccagtaagcaacctaccctacacggctccccctttgccttgcttaggttcatgctttgacatctgggaagatgatcaccgcagagaggctggggctgttgtaatgataaatctagtatatatgtccagtggtacttggaattggccttttgagtcaaggaagggagtactactcgcggtttaaacagtctgaaggtagaacttgccgactcattcataggtggtacactaatgtaactaaatgtaggtactttagttactaaagcctatagaaaataatatgtacaacatgtataacaatactagatagaagaagtcggaataggaaatgaggttcatcaaacagatggatacagtattcactctgtattgaaattcatcacgacgtcatgaacagaaatgaatgtactcgagaaaaaacacaaggatcgattgacccgccaaaaagccaagaccgagtgacagcaccgaagagccttccttactgctccgcatacttactcatctacttgtgctcactcagattctatggaccatagttgacggctcaacagctctggtcaggtccgtcgtgctcatggttgaggatgtcgtgtgccgcgcggcaatccagatatagagacttcggtagatggatgcccgtctgttggtgctttgttgatctttctacactgtggagcctcgacgcgtcaactggttttaccttacggcagggggattcatccgggcgcaccaggacgtcagcgtgtagcgaaggaagagatcagcaccaacgactgtgtgaattgctgttaggaatacactgtcgttgcaatgacacgaaccatgaaacgctggataacagtatgcctgtagattcttgaaagcaactgtgagatgactggatctgggaaaagcctccgcgaaaccgattgaatttttattaatagtgtcgctatctggggtctgattcctctagtgtgtgaggatggatctaggcccagaacaatccctgagcaagaggatgtcacccagtgttggtgttggtctagttgccaacagccgagcggtctcattcgccatgagccgatgtctcaccgtgaccgtcaaggaacgggctcgctggccaacagcaacagggaatggagcagcagatctctggccctacgcaatctccaactaccattgggaccacatcctagggctcctactgtacgtatttccaaggaaggatttacgagctccgcgacgatgccggggtagcagccatgaagaaagtatatcaaggcagccctccgtctccttcactactcagaatcattcccaacaacatcgttcagccttttcttcttcttttctcttttcctttcttctcaattcgcttctttacccctttgagctggtctcataggatttgttttcccatcaaccttttaccaaccttgtcattttcgtgtattcatttggttggtttcaatccgcaatcatggttgctattaagaatctcacggccatccttttgggtgtcgccagcgtggcagtcgccatgcccgtttctaacctggtcgagactcgtgacatcgccctcaacgatcaagacctggacattcgcggccctcctcagcctggccacctccaccgtgccaagtctcttagccaccaccgccgtgaagaacttgaggagcgtgctcctcctgcacctggccatctccagagggccaagtctctcagtcaccatcgccgtgctcctcccgcgcctggccacctgcagagggccaagtctctgagccatcaccgccgtgatgagcttgaggagcgcgctcctcctgcacctggtcacctgcagagggccaagtctctcagtcaccatcgccgtgctcctcccgcacctggccatctccagagggccaagtctctgagccatcaccgccgtgatgagcttgaggagcgtgctcctcctgcacctggccacctccagcgtgctaagtctctcagccaccaccgccgagctcctcctgcacccggccacctccagcgtgccaagtctctcagccaccaccgtcgtgctcctcccgcacctggccatctccagagggccaagtctctcagccaccatcgccgtgaagaagagtccttcgaggacctcttctaagcgcctcttaagaaagagctgctgttttgaggcgtgtcatgatgttaccgcacgagagcgatgttcatttccccccccaagtgggaattcttgttagctttatgattggtttttgatggataacaatttaatatcacgatgcaatggcttggctgttgtattgaaaaattcttcttcacattgccgcttccaaccgtaacatttctgtgatatccttgcttgttaaattgtgatagatctccttagtatagacaaggaaccttgagtttttatcagtcactatgtgtcatctacttgcttcacgatctctagcaaggacgaactggaagacagactttagataacattgcatactacttataaactgtcgttaagtgttttactctagaattagaattattctttccatatcttgtttcatttgcatagcatatgacattctatacagggctaactcagtattcacgtcgtggttgaagaaatttgaaaatatttttttgactaaagaaacatgttgtaatcccgatatcttctaccacctatatagaagctggtagttctaaggcttccgcgtgatccgtattgtatggttgaaactggctttcattacatgagtttagctgattcctgaggattctgggtagtgactcaacccctggatccataaactggtactcatactataacgtctatatcttgttcctcatttcatcgggcttaaccgaaatgcacagtctttaatagatctatgaagcaggggtccgatactgtattctagaactgactcatttaccaagggagatgaacctggcttgatatgaggtatctcgaatattgcggccgactacccttagacctgatctatttgaggacgatcttctggctagcatttgacagctcgctgaaagtggcaccttggtggggttctttccagcagaggcatcttgaaagctctcaagcgatcttagaagctgcataggaaactccattatctaaaccaataaaattgacactttggtagacgttagatgattcttaggtcttaggagattgatgtgggttttgtatcgctgttgatcgccttccattagcactgtattcggagggtgtgatatcagatatttacggaggcctagcatcgcttgactagctgttgacaagttcaacccttggcctccagcatgttgacaaggtggaggcgttcggtattgcagaaccttggcatacaccggagccattccataatccagtcgaaagtcgtatctctgtccataggaatgcacgcatcacctgcgtgcattgatcaacatggatcctggatcattgtgtaagcgggctgtttcagacagggaactcgaacaggctcattcgccaagaccttgtgctgtattttaaatgctagaagacccgccagctttgtggacggcgcttctcatccatattccgccacctaggtacaggagggagggctgctgcggctgattatgatggctcgctacacatttgccgccgcgatcggcttcttggcctgcacgggtgtgcactcgcagcaaacaaccacccaggcaatcgcgagcgtgtacctccccaatgctgaccagttcgcttacggggtcatgggatcaatcgtctctgccgacgcgaacaagacggctctgaagctcgcgtgcccgcccgggaccacgctctgcggccagtacatgtacggcagcaccgtcacttacgggccaacgaccttcatttacgacgacccgctccggacacttacccagccagatgtgaagtcggtggttcaatggtaagcctggtttctccagctccctgtatcggcgtatacctaattgagatgctgcgctagggcgagccatcgagactgctcccttgatgacgagggcgacgtcgccgtatgcacagacgttgtgctcttgaaccggccgacgaccgaatcgatacgcaccacgacgacggtcacggagagcggcctcagtttccggcgcactccagtgaccatcacggcgggtttcgagaatctgaaaccatcaccgggttcttccattgggacttcggttgcgccatctacgacacagcaaagcgactccaagtcaacttctggctcggcgactgcggcttctgagtcaacgcccaccacgtctggatcgtcatccgatacttctgtagcagctgccgcgacttcgacatcggcagagacaaatacaaatggggtgattagaagatatagtaacgtgtcttttggtgccgctattgcgggtttggttgggtggcatttaattaattagattatacctcatctgcgaacaaaatccaaaaagagtactactatctgctacaaatataatcgaagttcttttaaatgggagctgatcatttgccaagccaactacgccactgaaattcgaagaaaacgatgccatcttgtcactgcctaaagttgccacgcgccgatcttagtaactatgtatttagctgtacatgtgaagtggaggtggctatgctgcctagcctgggcttgtcccatggttatttcctgtggctctgcctactctttgttgcagagtgatgtgggtgagtgattatcatacctggcgtttcctctagtaaaacttacagaaaggttggtctccaaatacagccaatttgattctgagatcatgctctaacatggccctggcgcctctagtggcatatgcttaatcagggaattttccaggcaacgctgttgaaaggcgagtttccatttgtgggtgtcttggcgtttggtcatttcagcccatttcctgctgcgcctccagcaccgacaagggcccatcgcagccctataacgtttcggtgggtggcctgcaggctgcaggttggctgcctagttatttgtttggctcactctctctgcttggtttctacaagtcaagatggacgagcagcggaggtctggaaacccccctgacggaaactatcatctttaacggctcatgccgtttgaatattctgcattttctccgatcgtcgcctcttcactagtcagtaagcaccagaaactagagcgttaagaatagaatccctctaaaatttggtggtgtatgggtggaaacgccaagcaccacgactggcttggcgaagcgtctggacaaggatgagtcgggctatatgtaacgccgccagcccagattaatttaaaacccgggcgattgatgatgttccccagatattgacttcttttcctcgtcaaagaagatgtatccaaaggggcttgttgtggcctcgctggctgcgctccagctttctggtgcccgcgcccagaaccaggatgaggtcaatccttgccgggccatcatgaatgagcagaaacagaacctcaggagtgcgaatgtaacgtacgcaacggacatgaagtacctggtaaacttcgatgcggaaaaggcctacgagtgtatcacgtccgttccgctggtcgccgaggaagccagcacgatgatcgatgttttcaagaattatttctccctccagagctctcttgcatatctcaaagatcctcccaagtcgtatcagcggttaccagtggatgtcatggggcgcttcgatgcgatcaagaccaagctcgagtcgggagagtacaaaaaccagtacgagttcgacctggctgttcaaagcatcattcgcgatgtcaacgactaccacttctacgtatattctggagttcttggactattccactggaccttgccggagtcactcaccgcaatctcgtcggacggccagagtctcccgcagctcttcgcctggtccgacatcacaaacaatgtccagaatgcgtcggcggtcgtggagttggagggccagtccgccttcacctacctccgaggctacctggagcggacctatttcctgggtttcaacgacccaaacgccgactggaactcactgatggagaacccggccgccgatttcagcagcaccggccggggcaagcagagtttgcactacagcgcatttcagacgacccagatctacaacggcgcgtcgctcaagggccgttacgctaacggaactcaatttgagtggccatatacggcgggatcgacgagggatttgaccagatacagatactacaacggctcagccatatacggaaccgaagtcaagaaccggaattcgacttatagcagcagcaatttcgcctcgagggctaatctagagaaggaatacgaactacacgtcgactctcgagaactggaggcggcggcagattgggaccgggccgtcctcgcggccagaagcgccgtcaactcggtcccctacttcggctatcccagcgaccccgacctggtgcagtccgactttggcgagggcggcatgatctcaggttacttcctcagggacgacaagatcggcgtcctgagcgtgcccagcttccagacgtccagcgacgcgagccccgcgaccttcagctcggccgtcaggaggttcatcagggaggcccaaagcgccggcatggagaagatcgtcatcgacgtcatgggcaaccggggcggctcgctgctgctcgcgtacgacatgttccgcctcttcttccccagcgcgctgcccaacaccctgttccgcgcgcgcgcctcgtcggacttgaagacgctggggaatattgtgaccaacgtgatcaacagcagcaggtccttcgactcgtttgatgctggtgacattacggtgctgggcgccgctggtgagttgaacaccggggtgctgctgcaggccgataactcgagctgggattcctacgatgactatttcggacccgttcagagccacggggataatttcaccaagaatgcccagtatgacctgaatagcaggtcgattgcgaggtcgctcggcttctatgttgccggttacgggaacaacgtccccacctacaacgagacctggaaggcggagaatgtcattctcctgagcgacggactctgtgggagcacatgcgccgtgctgcacgctcttatgaagaacgacgcgggcgtcaagagcgtcgtcgtgggcggagttccgggatacgggcctatgcaggtcgcaggaggcactcgcggccacaacgtccgcactctcgatgccctcagcgacgtgaagacgactgtccagtacatgatcagcctggccaggaaccccaggcaggtgctttcgatcctgggcgtgacggctgacgatgtgaacaatctaccgatgacgttcgccgagacgccttggagggtgggtggtggagggattaacgctctcgacacggtcatccgagccaaggacgacgtgcctcggcaatttgtctacgagggcgccaactgccgactcttctggacgggcgaaagggtgcgcgacatctctaagctgtggcgggcggcggtcacgtatgcgagcggcaactcgaccatctgtgttcctggctccgttgatgggcctggatcgaaggcgaatgccaccgttacggacgatgttggggtctcgtacaacaagacgtgggacaaagtgaactcgacggatgttcccaagacgaccaacaccgggagcgataagcagcaagagaacgatgattcggcggcgtcgacttatggggtcggcatgacgggtctaatgacgattatgtttgtatgggctttatggctgtgagggttggagtgaaaatagaactacatgtttgcattccatagagcagaatagactcttgggtatatattatttgatgatattatgatatcaaccgagatgtgtcaattgaattctgatcgtgactattcccaagtaagagacctattctcccggcaatcactctcatgcctcccactcaattgcctggcgctcccgccgtcttcggagcttgggcctctggagcgtgttggtattcttcttggccggcaagatcgccttggtcgtcttcttgatgcccgacttgaccgcatgctgtagctgcttgcgcccgaccgtgaacctgtccttgatcgtcttgtcgccggccttgtagttcttgttgacgatcgcctgcatctcctccaccatcttggtcgcctcgggacgggtcttggccagggcgacgttgctgatctgcacggtgttgtggtcgcctgggttggcctggtacttgttgttggaccaggccttcatcctggccatcgcctggctcgccttgtcgtcgggcatctggaggctcttggtcgtgcgcgagggcttcttgacctggtcgggctttgtcgggtctgcgaatcggccgaggaagacgacgcgggaggcgagggcctggctgacgaggaggagcaggccgaagaccagtgccctgagactggccattataagaaattacagcgcaccaggcgctggagatcagattcagataagaaagaaatgcaaatgcctgccagcggcaacttgcacggactggaagaagcgaagtggaggaggagaagcaaggagtaagatcaaccacagcctcaatcgaaggcgaggtcagacggatccttatatttttattcttctccgttctgcccggccttgctgcaggtaagacgagtttgtaaggcgatgccaagccagaccagcacaaatgcccaaccaacgactcgagctcttccaatcagccgtgtttcatcatgcttcagcgccgttctggctcggctttcgggccacagccccggatcagcaccaccattgtgcatgaatatttgccccccgcagccaaggcatttagaaagtcacgctcccagactcgtttcattgattgctgctgtgtttggagtctttcatctgctcacaatctgcgaccgccaaaataatcccctaccacccaccaacacaccacgctgataatggcgccggtcaatcacaccatcttccatcacttctcccttctgccgcctgagatccgcgaccagatctggcacgatgcgctgcctgacgcgactcgcccggcgctgttcctctaccaaaaaggctgctggcggccacgtcgcctcacgccaggcgacgacgactacgatcctgtcaacgaggattgcaatctcaacatggagtttgattataaactgctcacgccggtccagtacgacatcccactcgcatttgtcaatcgcgaagctcgccgccacgccctgggatggatcggcgcccagggcttagacatctgccacaacgagaaccggcgaccgagcttcgttcgccatttcgaccctgatcgcgatgcgctctacgttcccaccgagaaatggtgggagttcatccgggagcccatcaaccgccagctgcagcccgacctggacgggcagaccatcatgctcaagacctatgtcaagcacctcgccgtgtcggattcgctgctccagatgaaggcctcgctcgggggcgttttcgagtactacttcaaactcgaagcattgtacgtcttcaaggagaaggcgctggtggccgagttcagccgtggcagtttgaatagacaccaggtctatgagtatcatcccctgcggaggggaatgttcgtctgggacgttggccggagcaaattccactatgaggaacacaaatctgacagggaggagccgacgcaccgtctcatcaagaaggcagctgagcgactgcggaaagagctcgccattgaggcatatgatgggtttcagattcagcgggccaaggtgcacgccagagtgtaggcttccgtagcgcttggaacgaaagaggacgcctggagcttctctgcataataaattgtatagacctcttatttcctgggcgtgctgtgcctagatattggtagacctcataggagggtgtctactgtcatctggacatggtttctttttcttcctttttttttttctttcacttttcggcgagagagacccagacttttgcaaagccattgaatgtaacacgatatagagccgtctgatgataaagttcgactgtcataataaataatacaagtccaattgaagcacataactgtcacgaagagcaacacttcatccactactgatatcatcggtaccattgaccagactgatggagggatagatattgcccatgccataaatatagtgacgcacacatcaaagtaaagggtgttgcttctgggggcggcggggatggttattagctatgccgtcggtaatatcactgggcggcaacactagactaccgtcaactgtcacgttagcgacgccacgggaagccacggtgttttctactgcttcattggaaccgaattctacttgtctagcaactttcatacgagttgcatgcattatgagtcatttcattagcttcgtgtgccgtgattgggggctattgagggctctgtaactcttgagccatgggaatataaggacaaacctatgacgtataaagcagctcaacacacatgccatgattgtcttaatcaatgaaacactgccaaccgaagcacaccatctcaaacaggtggtcaggggttggagggcccagactggtctaaacgcctctttcttttcagctcctgccgatgaagttaggaggagacaccatgaggagatcaaagccaattagatttcgtgatatcagccgtatcactgccaactcaccaagcggcctgcagcagttgtaagtttatgcagcgtgatcattttggatccactcaggcgtcggaccataggctcttgatcagtcgggatcagctagatagaatgtagagctggcagtaatcgcttccttactatcatcaacatcttgtttgcgtgactgttgcatatcaaaaagttgtcatatgaatcattctgtactaggagagcaatagtatgatattcaggtatcgatcgtttgtgtctctcctttatttgcgcgactgcttccaccaggccgtgctgtgtcattcggcaatgacaacagaagtatcaagttaaagcccaataagtcagaagctaaataatgatgatttcaaaataaaagccccccgtcatttgaggcacatttgagacagctcgcttctcagcttcgctccccagttgctgaccagctgcgccatttctcacttagttccctccgtcgtcccagttcgaggtggttgaatttggctgtccgtcgtcgttccacattgttgcaagcaagacttgattgtccaaaggtcctgtcctcgatcatttagtcttgctcttttgggggtctcattctgcgcttacctttcggaaagagatattttgatgatgttttatgagaggaaagatagatgatagatgaagtagaagtccctcaatttattgtcggccacatgccctatttatacctattaagtctcggttgtcggcgcagtttgttcacccctcggctcccctcgcgatatcgttagtgggagtcttatccatcacgcgactctaagatctttgatctgataggtgccattgttctaaggcacatacgcgagcaatatagataacagaacaagtcttggcatgcatactctgtaaagtggcgcaagtcacgcagatgcgatggattcagctcccgccgacctaggttagattgttggaacccagggagactaaacggccagtactctgtattgcctcttggaagctcaggctatttcttggactacgtgctctgtgggctggggcaccgagttcatatttttgcgccataacagctgtaggtttgagacatagttggggatgtctgtcacctcgactatttcttcatacaacaagggggttaatgaggcttctataggctggatatcaatgacaagcttgtgccaactaagcctgtcactccgcatctatcggtcagctgggcatccatcaggcatgtacgctccccatcgatttttagctcgccttctttgcttcggcgtacccccgccacgttgctggatggattccactgctcctttccatatatctgaagtttcacagctttgaactgaaggttatagaataatgagtttccatgatttatatccatccaaccatacgccattgcctggtttacccttgccgtaagagagccgagttgcgaaggacaagtcctgttcgttaccgggcgtgtgtgggttgccctgctctccgtatactcgttcgcactctgctgaaaggttgggtaagattctatcaagtagctgaatcaattagctgtatcaattagctgagaatttatatggttattcggttagggtgttaaatacctaattcaatgtgcttcgcaattgcttggtcgcgccggtcgtttagtaagtctttcctgtcgttacttgcgtgattaggggagtttggaggcgagtttcagtcttgaaatgacgcaggcttatatcttgatatctcacctttcatacgtattactttacctatccagaggtattgatttagcttgcttttatttaggtattcctggccatgaactaacactgaaagtacacactgagtacagactgtagccctcgcgagccaagcgtggtattccagcctgtcactgtagtgatgtctatttctctacacgctgcgcggactgaccgcagttaccaaaaagtgcagacaatttcggcttggttgagcatttaggtgaggatgtgcgacgacacagctcgttagagagagccgttttcacgtcgtcacctaagccatgcaagtatgcgtgcgggtaagcttccaaacttggaatatcaaatggcttgctcagtgcaatggccagggcgtggtttctaaccaacgcttagcaagggccgtggcaatctcatttgactgccctgagatctaatttgggtcgcccggcaattgaatcccttcgcttgttaaccaatcatgtggacattgtgacctgtttcagggggtcagacgatgacataccaactcttgtgcggcgcagtgcaaacctcacttggtcccgatgaaatcggggctgaaggttgctttcgtgcccaggcagttgatggtgtgattttgtggacaagtaagaaaggccaatgatcttcttgtcaacagtgtacacgaaatcatcaaacgtggatcgtgaaagcgcaaagctatttcactgcgatatgtaaacatgacatgcctaactggagacaccatatgcgctaaaacacgaattaattagatgaaatactcgctctgtaattcgtgagggatatgagatagaagcgccagagaagacatgatgtcatctacaaaggagtgataatggtaacggcgtagcgcgtagtatcgacgcggtgtgaacggtaatgaggctaccacattggcacatctctattgcaagacaaaatatccgtcccaagtattgacggaaaaattactagagagattatttgggtagttagagaccaagtccttagttggatgccggaagagaccgggagccatgattttggttcaacgtcaccacgcccagataactagattagctcataacacatcgacaacaatgataatgtgttgaatttcgcttctttgtacattggatgtctaaccgagatcctccgtttactcgaggcctgcatcatatctaatatgaatatcaaaaagcatgtttctaaaaaatagtgatacaaattgaataacaatgtgtttctgacgtccaaccaacgactgtttaatcaactcctagtgcaaccagccatcacttggatcccggagaaaaagtccctatgtgtgtgcctaagcttcctcctcatagctgaagcctcgcttgcccttgccactgctcgggggtctaggagcagaaggttggtagccggaaaagccgttgctcgtggtcccagaaccgtgcccggcgtggctgccacgagggcctgcaccaccgcctcccttgcgagtctcaaggctgcgtttgcctttaccactgctggagggtctggcagcagaaggctgatagccggcgaagccattgctggtggttccagaaccatgtccagcatggctgccgcgaggtccggcaccaccacctcctttacggatctgaaggcttcgcttgcctttaccactgctggaaggtctaggagctgaaggttgatagccggcgaagccattgctagttgttccagaaccatgtccagcgtggctgcctcgaggtccggcgccaccacctcctttacgtagctgaagacttcgcttgcctttaccactgctggaaggtctaggagctgaaggttgataaccagcaaagccattgctggtggttccggagccatgtccagcgtgactgcctcgaggtccggcgccaccacctcctttacggatctcaaggcttcgcttgcccttaccactgctggaaggtctaggagctgaaggttgatagccggcgaagccattgctagttgttccagaaccatgtccggcgtggctgccacgggggcctgcaccgccacctcccttgcgaatttcgagatctcgctcctccacagttgtgtcacagacagcattctgagcgaggctgagtagaagggttgcccctagagagagttgcttaatgccaaccattttgagatgtggtgttgataagaaggattttgaaaagtagaaagtaaaagagaaaagagaaatgctgtcgagcaatatagaaaatggtagctaatttggcttaattgttgtatgaaaacagatggagaaatgaagaatgatgatgagaataaacaagacgatatttcggagtagcaacgagtctttttatatgttcatgagcaggctttaaatagcgactcttgcgaactgatattctaacaatagaaggttgtccttaggacgtcttgtgtattgacccctacgctaacaaacagtcgaaaagcagggtgtttgcgtaatgggcaggtagccaaacgtcatttgcattcggtgatgaggacccagagaaggatgcaatcccaggaagcaaggctaaaaaacacgggagaagtccctctctggggttttactcctactcagataaatctagaaagtgattgccatataagctcccatatttccgtcgctataattacaatttgatcttgtatgccagcgttcattggccgatgtacgcttgtatgcctgtgttcattggtcgatgtacggcaaggattctctcaaacaacagatctcacccaccttaccgaaatcgacgacgtattgaggaaggatgccggcttgtggggcctgagtgtagagggagcaatgttggagcccccttaagctttgctcgtctttaatcaatgccttgggaccgcggagctgcgccgcttaatttatcatcggcattgcttcgccatcttttccgaaggaggatgagaaactcccgagtatgacccctgttgtgtctactaccagtacggataggtcatctcccaacctaatcggcgaactattgaaagcaaagggtagtctatcatttctgcttatgacgcgacgtcgtctttaatgcttcaaacaggagctaggccaacctgaactcgatcaccgaaaaaaaaatgcttccgctgcccagatccgacaaaatagcctctggtatcttttgtgcaggaagaatcgttagctcattggttggaagttactctcctggcttcctggaatcgatgaaagaggataccgacttgctgtagagcaaaaatgtaattagtcacgtcataatgctgttcaggatgatggctctcagaacgtagctctgctgcacttgggtgcggacacacctacacacacataaaacaatggtattcttatttggttgtagaatacgtggcctgttaggtccttctcttgaattattattctcaagatgagcagaaggcgctcctagaaacatattatttatgatacgcaagctttcgaagtatccggatcttctgtacattctatgaatagctgcttcgtgagagagactaacgcagcctcaagaaaggagacgccattcacaagggctaaagagtcttcccagcagttgaaactccaacgctatgggggataggctttggctttttagagatgaacgtatgaaccaaggcaacactgctttcctcctacgaatagggtgctcaccaaagcacgcgcaatgaggagcaccagaaacatagtttggcctattcttttcaaccaagattggaggaggcagcagccttaatataacttgcatcacgccacctgtaactgtctgacttcgtgttctccggaggtcccaaaatgattatttttagctaggttggtatcccaccttgtctacctcaagctatgtagaataaagcagtattagtggcttctaaacagaagctcaagatcagagaacgcacaaagatcgaatccggaaattaagctggatatagaacaagcacggtgataaaaaaaaagccgactagccatgccccgtatcgatttgtaatgtagttttgcaaggtaatcccaacgtgagagctccactaccattataactttgcttctataggagtaaagaattagtgtcattaggttcaagagccttggttccgcttaaccaatgtagtataaagcacctaccgtctcggtttacatggctttctgtactttcaatgggattctctaccaattggagcctcagcttttgcgactagggaaacatagctgagattgttagggagcttttgagagtgactcgatacatgatacatgccttttatataacttccaatgcgtgtgttgatcctactcataatcatactgcatgatttgatgaaggaaaataagaagacactttcctaatatgaaagaaaaacagacgtgataacttagctattcacatgtataaaccccctgaatctgggaaccgcaacagtatgtcgccaggaatgatggtatcttagcacggttcactcggccggaatatcattcggcgagacaacgagatatcaatgctaatgacttcgctaaaacaaactaaatcctatgctaaaagaacgaagttctccgactgccaaccctgcaagttttccttccacaatattcgacacgcgaaggaacaactatttaaagtgccggttaagcttttattcagactgaaatagtatgaaacaaattgatgtaatgtcaaaatattccgaaattcagcccagatttaggctaccagtctagtgctcaaattgatctgatttgagcctacgaaaattggatgagtattcaagctagcgctttgaaaccacacagagacccttccaattgttttgtgactgccctaggtcgataagcaggtattttaatcataagtccaaggagaagtatctacggaaagattgagaaatccaaaaaagacttgagggcgttcgaagccaaccgagacgcaatgcaaccttcattggtatctaagagatgggaataaacctcaccttctagaagccatggccgtagacggcccagaaaaagagccttctgaactcttgaaaatatatgttcaaaatctttgagacgaagtcaatgcccttcttactgaatcacactgccatgtcatgtcaattaccctctgcttatgtcattgattgactcacaatgaagctagggattcccgaagtagccaggaaagacagaacgttcccgactcaaggccgaggcacatcgatgcctggcgccaagatctagattgccttggctacgcctagcatactgcccaagttggctagaacatagctggttagaacagcatacttggcacggtggcaagagtggcttgacgccgatcagctcctttctttttatgcatagtcactagcctagcgaataagttagcctccaggctccactgagctgaaagtattagtgctctcctgaagatgcagccattccaattcgtttataaggcccgacctgtccccagaacgatttgagcttgttctgcccacttcaaggtactcgtcttttgcttagagtgttcagcagtatgcattcgctatctcttctcccagtcacactattcttagccatagtgcaagtggtctcggccactaccgccacttcggcacccacgacacgagctcgatcaacttacgtcaccacctcattctactcactcgcgacgacagaaattcctcacgatgaaatgagtatcggaatgggtcagaatgggactaagggcaactactgtatggctccgccatctcgtacataacacgacctcgtgctaaatcttccttcttagactggctggcttgcatcaacgagccattcaccacgcgaggtgaatatggtggctgtggctctgatgatttatatactcgttgttcaggaaagaccgcgtttggaattgacggcaaaggaatcctttggtaggttcctccaccatattgaagggccttggctaacgaacgggcttgccttgaagtgatgttggatgtgtaacacatagggtttatcaagatcttgatgtcacgactttcaccccatttgtcggatgcggtaggggaacaagtactatgaacttattacgcacgtcaacatcgtcaggcgccccaggtacgttatttcggcgatcattgtcgatgatttatcgagaagtctaaccttcaaggtttagccactacttcgaatcccagtaccgcgaccagtgctgtccaaacgggcgaccaaaataacagtggcgtagttttagacaggagttccttattcagcctgatgtttgcgttagcgaccttgatagtttggatctgaaagagtgactggaagaactatgtgtatagcgatatattctcaatttaacttaatattgctcaaattggattatcttggatctccgtggaaagttaacatcaaaatgagaatagataattgcctttgacgtcattgagctctccgaagcatagccaatgccccatacctgcctgttaacgtggctgtgcaggacgatcccaaagaaagtgctctgcctaattcagtattggcttggcttggaaatgccccgtaagtaaactaagcgttgatataagagcataagctgcgggctgcgggcggccgcccgattcagcttggagatgcagttgaccgtgaggaatcaccaatgtggcacgatagctcccctcccctacaacatggctaacggcgcggaaaggttgactcagccctaacattagagtagacttggctgtgaatctgacagacgcctcactccaattctcgaggctaatttggcgattctttcctgcctgtatcgctcccagcaacatcatttgaggcctatggcaccggcgagtcaaagtgcgtctgccacttcatcaatgcaaaactatctggtcgttgatttcaaaattaaaggtcgcaaatagggaattcggctggccaaggttccaacctagaaactcgcttttttttttgtgttttgtcccgacatgcaccgcatgacctaggtatctaagtttaaatggctctcttcgaaagggctatggttcgtagatattttcatcttcgaacttttggtacgcaattgccgcgcaaattatgagtctttttgctgaggtatttcagttgagagtatacttcgttggggctgtttgaaagaagggaccggaggaagcttcgccgacgcctccccaagtagcaatatgttcagaatagcgataggcaaatctaatccggctaaactcagtttcgttatctgagatggggtatgaaggttactgtgtccagaattacggaacagtgatgagaaagagaaatctgattaagacaactttgggggctacgatggtatactcggcacctttttttgacggtcacgaaaagacggggatcggagtttatagtagtttcacggagagaattcacggtagatcttcgtacaacatgatttctagtatctgtgaagggttgctatgaggtttgtcttcggtcaaagacttccggtcggctcgaagtcctcactaaagaggcaaagctggaacatcatttcaagctgttggggtgagctagtgcgtcaatattcgcctaaagctcataacgaagcatcgatttaccctctttgtttcccatatacatttccaaatgcgcttacacattacgatggagacacaggcgtgacttgtcgcgacccttgttccgaactaggccctttaccttacatctatgcttatgtatcgtgattttcaaaaattttgttacgagaggaaccttggatgttgcgaatggaaggctggtatcagagttcgatgtgattagggcccgcgcttggatatgaacttaaagttgcggttgtgccggatttgcggtgtctccgcttcgctctatcatacatatgtgaattcacgcatgccattcaaaagagcttagtaggtacagggtgggcaattacacgggctaactttactcccgatagccgcttactctcggatacaaatagacgccctaccctctatttaatgtcattaaataactcttcggaatttctggcgatagccaccttattacatacagcaacgtgattggcaaattcatttaacattccaaatggcgtcagaatcgactcgtaagctataaagattccttcatgataaatcaaccactaaccctcacttagacccgaagcactttggccttctcgtgtaccctggctttgaagccttggatgcctttggccctatggaagtggtgaatgacatatccttgtcgcataatatcacactatcgaccattgccgaaactctggacccggtctcgaccatcaagaaaggcaaacactctgcgggacaaagtgttctgcctactcacacctttgaagatgcccccgcacttgacgtgctgatcatccctggaggatacggtggattcgagactacacccaaactgaggcaatggatcagcgatactgtgccaaaacttggcacactgattactgtgtgcaacggggcttcgctggcggctcaggctggcgtgctggatggcagaagtgccacgacgaacaaggcgctctggaaagagtgtgtcgcttacggccccaaggtcaattgggttgccaaggcgcggtgggttcgagatgggaacatttggacctcgtctggcgtcagtgctggcattgacgctacactggcctgggttgcatctgagtatggtgaagagtttgcaaacaacatcgccaacggtatggagtttacgagggccagctcatcgacagatgaccctttctcaaccttgttccagtgcgcggatgttcctccccaagcttaaagtacataatcaatcgggcgagttataagtactcatgccttaaatttcagaataaatcccaactcatttagaaactcaagctgcacctgacagcatgctttagatagtaaacaagcgtgttttttattcccattaatcccagccatttctttagtacataacgagtatatctatcaagtcttcagtcgatggtaaacgtttactcatcggatattttggaaatagaaataatctgggtaatggccgcgttgcacatcatttaagattggcagagctggcctaaaatctacgtgtaatagttttctatttaaagattatatcttcccatcactgtttagtatgagtttaaagtaataagcagtagtttgcagcctaggaaacctgccagctcgcttcagggtaggtgagtttatcagcactgaccattgaagtacagacgcgatttgtctcagacacgatctgcgcttcatttcacgatattgcaggcaactctacgtcatacatacacagctccgtatctcgggcgttgggcaaacattgcaaatgaagcaacgcaaatcccgtcccctgttaacgtgcctccgctgggggaacgaagtcccaatattcgcagaggaggaacgtccacaaaagatggaggaaggattacttccaagaattttcttggcgccatggacgtagacttgatcgaaaggatcttgttctcagatgatgaggaggaaatcgacgacgacgatctgcgcttattgtcctataatgacacgcccggcgaagtccggacaaagattcgcacatggattcagtctggcgcctagacggaagctgacttccaacagaccatcggagtcgatcctgaagagtatgggacatacatgggttacttaatctccctttctgaccaaacgagcgatgttcacaagaaggcctcgttgtttttccacaaacgagagttgcaaggcctgcccatcgaaatccccgagagaaacgtggcaaagccagaagctagcaagaagaagaagccgaccaagagtgccgccaagggtaaatccgattccaaggagcgtcttcttgacgcaggcgactacattcttcctggagaggtagaaggcgatgtcgacatcttcgaaacgcctagggaagtgcgacgaaaaatgcgagctctcctggccaagggtgtgacgcaagcagcatttgcgcgagccctaagtcagatgctcccagagggtgctggcactctcaatccacagacaatgaaggcattcctagcacagaaaggtgtgatggatggcaacaccagcaaagcattctactgcgggtatgtgtttttcgagaagcaccggcttcgagataacaagcccatgagtaagcacagggagaccatggaagaactccatcctacgggggttgatactaccaataacccgaagaccactcgctatatcgtttcctcggcaacacgaagtctcggctacgatcaatatggtgtcatgcactcttctcgttattaggagccaccttattctcttgctatgtgtattattttaaatgatcaattcatcttctctagcagttttttgcaaatcgacgttctaaaggttggattgcggtgattttcatttttgaaaggtgattgtctcacttgtatatgatttcaacacgctcagcagtgacatcaacttacgattacctttaccggtaatgtacaataagtctacctgtatcaatatatgaaggggagggaagcggggtttctattctctctcttccctctgttcattgacttggatagtgtccagagtgacagacaagtttgtcaatgggacttgaaacttatgtcttccggcccagagataatagacaagtccaaacatggaccagccagcgacaacgacgatggagtagttcatgttttgcgccgttacgggtagagtaagcggaaatgtgctaaagatcatgacgacgatcatccatatcaagctgacaatatttgcagcgatgcccaaagctcttggcattcgaaatggtccgaagtcttcaggacgcagctgggagcggccgaagacaaccatgaaaaagattggcgagagatatgaaaggtatagaccgataatagccatggagagaaccgcgttgaacgccgtcgcattccccagatagatgagaccgagaagaacttgcagcaagatgacgaggatcacagatctgaggggcacctggagccttttatcgacaacacctaagtacgcgtcaaacggagtagctttgtctcgagcaaaagcccaaagcgtgcgagaagtcgatgctaccccagcaacggtggcggccgtagcaacaataatcagggtgagggacatgactgtcgcaccgaccctcgattgagtggcatcaagatagatttgcatgaagggataccccgttggagtctgcagtagtgaatcgagtgagctggtggagtagaggagaacgatgcaatagacaagacctattaggccattgacaacgacgccgccaatgagagccagcgggacattacgactcgcgtgcggcagctcttctgcaagatggcacgctgcgtcgtaacttgagatggtcagtacgccttgctcctcgtatatccagaattcagtaacatacccaaggaatggataaacggtgctctgcatcccgacaagccaagaaactccatcactgctccaaccgctattgttctcgaattccgtaaacacaaaactggaggtattcttaggtgccatgactccaagcgtgataataataccaacaaaggcgccaatatgaatcacccctggttaaatatcagcagtagattcacggcctgatgtgtgaatactcaccagaaaccagattaaaatgaggcatcagtttgctgccccaaacatttaagagcccggcatatagtagtatcgcccagtagaagagcatcccttgccatcgagagggaacataggtttcatcgttcaatgtgatcagggcttgggtttggagcccagcggcaaaggcagaggaggcggtgagtaggatttgccccccaactgagatccagccagtcgcccaagccgctgcagcctttcttggggccggacaaagtgccgctacccaatgatattgacctgtggtagaaagacatcagtattgcgggaatactatgaggtctctatcgaacacatacccccggccgtaggatagattgaggcaatctctgcaagggaaacggcgatacagatagtgcagacaaacgacagaacactgagcagtcagctgttagtccattctcagctctcatcattgatcgactgcatggacatactaattgtaaaataaacacggaggaccaccactgatcagagcgggagcgattactgtagacagtgcctcccatgtagccattaagcagaggcacagtgcaccgagagctgggagagagaaagttcgacgaagctcctgttgatgcccaagctggcctaggcgttcttcatccgagagattctgccggatggatccattcttaacttcagtgcgagaggcagtctttttgagaccatctcccttcatgattgaggagtcgtcattcattgctaatgtctgtttgtcttttttacggattcgaagattttgacgggggctggactcatttataaattcccagatgttggacacctctcttagatttatgccctatctccttgattaacgacattgactttacccatgtcgtcgatatcagaacaggactgaattcttaggatagtacatgtatgcttccaacacaccacccaggggcaaacacacgacgcaaagtttggtcaatatcaagattacccaaagaagctacactgtgtattagcccgctgatgacatgagggcagttgcaccaatcgtgtgagcggaggttcgtgaagagaaacactaaacttattccgggcagaaagtgcgaggtggagatgcgaatcatgatgcatccacacaaccacactcctgcgctgtgcctttctgggtggaagagaccgaggtggagaacgagaggtttggcttgggacccaattttgatttttctaagcttcttagggagatttgccgcgagtctggtgcgttcgctgttcggcgttctgtgaatttcgtcagggttgctaccgaattgtgccttgacaatcattcatagacgagtagataaagattgggctctcgtggacaagaaacatgaataattatcaccaccactttcctaatatctgtcagcttcagccaggacgaaaatccgaacatattattgcttcatccggggctatcatttcttctttacaacatgagcgcaagtgtaggaactccaggctacgtcccagtcgcagaatggccgactctagaggagcttgccgttgggtatggcgagcaccggatggagaaatccaataaactggttggcaaatcattcgagcatgcatttgataacgggtatcgaatttcccactcattctccgacgacaagaatctcacatggcagatagtggatgggggaaatcaaactgatcacacgggcctgaagggcgaagcggaatatgacgcattcgaagtacgccccaacgtctttttcatagacttctacaaaccagcatatgaagaacaagtgagcctggttcttgacatcatcactggccaggcggtggtaggagtttccggatttactggcgttgctggggagcgaagaacctggaccaagttcacgaatgctagaatgagcggcaacactcccgttgaggcgtatcagcctacagacgagttgatcggcaagcacatcctgtaccgctatacccctcgggatgcgtatgagcacgtttacttgaaccagggtactttggcctggcactgcttggctggaacagaaaagggactggctgacgccgaggagtgcaagatgctgaagttgggagaatctctctatcttctgttctggaccgagaccatcatgcccgtggagtcagtggtcgtggttgaccttgagaagttgcgatctacgggacgcttcttctgctgggatccaaagccacagcggatggttcgcatgagcttcggatcctacgctacgatccttgcggaagccaatccagccgcaatactttctcagccggcgaagccatcaagattgtagtgaatcttatcgtgttgattcaatctgtacggcgggggggacggagtcactgctgtagtttgtgttcgtcagcaacataatccaatgatatggaaaagaagctgggcaagctatgtacgctactcatctcggcaaatacagtttgaaataaattatcagcatgtcaatggcagtaattacgtaggtataagcttgccgcttctgcatcagactgagtgatatggatagacattccagagcaagcattcagctttgagtggcaccaagctctatttgtagcacgaaagcagcaaccactagcttgcaagaaggttcatgccttgactcgtacgggaggggtctggggtttgctagcctgctgtcttatcaggagaagtctggggtttagaccgattgctagtcaatggcccgcctttcttatcatgggaagtctcggtttttttccgacattccgaggtaaagagtgatcaccacccgatgggcctaactccttgtttcccctcaacacgaaggatgttgtcacctccaacccagccagaatgtcaaccgccaaaagcaaactgaagtctcgctgtaagtatcccagtcttaggcttttggcacccggttctttgagctgtgctaacgaacatggtgtcagcgggctgtgctcgatgcaagcaaagggtatgtgatcttctacgcttggacgacagcaactgctcacgggatatttcagcgtgtcaaatgcgacgagacagtgccgaattgttcgaattgccttcgaggtggcgccaattgcccggggtaccgtaggtcggttaagtggtctggaaagcacgaggtttttcgaagtggatttcaagattcggcggcgggacatagcatggaacccttctggaacgttttcgaagagggagcttcacgacttcatgctgtattggtggcggaggccgcgtctccgcctcatagaacggtaacctcgtcgccggggagtcttgtgagcgagcctctaggaaccacagcaagtcaagagcatagtcttcttgaaacagggctttctgagataaatgaaccgccagaactcctgtcagatgatggcaatatgggttggttgggatgggtaactagcgaacagtccggttccgagttccccgtaacgacatctctaagctatatccctgactcaaccgactacacaccatctttcgatgtcgacgctaggatttgtgaaccaaaccccgaaattgaactgatacatgagatcaatccaccatcccactcgctattagcgatcaactcacgagaagattacctagtcagctattatttttctctgatctgcgttataaactccggtttcgactcgcctcagaatccctttcgcatggtagtagctgacatgatctggacacatcccctgatactaaactgcatgctttctatgtccgctgctcatctttaccagcgacagaatgttccatcaacagaggcactccagcatcgcacgacggcaatatcagttctatcttcagaaatctcggagccatcgagtaagaatcaatttgggtctgggtcgcacttgatgattgccctgttgggtactatcttgcttggaacaacctctgtaggtactattactctatatttcctctcgtcagggaactgacacgatcgcatacagtcatggcatgatgcttcttcgaccgacacgtcatttcttcttggggcacgtgctctgctaaaagaattgaccctaaatcgtgattccgcgcctgacaattattctgctacagatcgatgtcgttcttctccaacagtcaggttcatgattggaattgtagcctattgggaagctatctcctctttccatattgatcaagaaccatcagcacttgactatctctttccattgtgtgattgggtagaatctcaaggctcacaaccgcatccatggacgggcatcagtacgccattatttgtatacatggcccaagcaggctctatcactcgccaagaacgtctggtgcatcgccttcgcccggaatcatcttcagacgataccaaacgaacattcagagctgcgcttttgaggagcgcaaggtggatcatcgacaatattcggcagtataaaacaccaccagctgaacagttcgaagaaacgagtgacactcagacgccgttgcaccattttcagactattgatcaggtatatcaactctctattattgtggaactataccgagtatttcccgaattagtggaggatggaaaagatatcttatatgacgcagggggcatgcccgtcgccgtatctactacagaatcatcaagccgtaggtttggggtgatggttgcccttgcggctaatattttaacccttttatcttcattaccggaatcctcgggtacaagagccattcaattgccagctttgatagttgctggtagcgctctgcagtatctttgcgaagaggaaacgagcattcttcccgaaacaggaaacgcctaccatggagtcgccaccttgttcagcaggaaagctgttgttttgtgctggagaacggcagcgatcgatagactgaagatgttgcaccgttacgttggactcgactcggtggatcgcggaataaagataatagagcatgtatggctaaaagctgacatgttggccgaacggaagcaacggagcacagttcagaatatcacaatggtccattgggtggatgttatgtgggacatgaagttagaaactcttcttggataaggatggtactattctgtgaagaattggtatcctatcggcagttaaggagcaacacactacgagatgatccggagagctatgcttgtacctatgtagagacggtgaccttaatcattttaattgtactcgtatgttactatagcccaggacgacgctgggatgttgatggtagaatgcattgagagtcagggtaggctccatagagcgagtcattggtctgaaatgtgttaatagttgagtggtaaacttcatgctagacgtctctaggcggagaggccatctttgatcccatacacaccggcccaatcttgatccttgacccaatctttcactgaacgcaaggccagaggaactcccaattccgttggtttaacgacagacttgtccactttgccgccatcatacccaaattcgacaccgaacatcagcatctccaagttatcctgcattctttctacgtctccccccatgtcaaataccgggttctcattcacgaattcaaccttctttcccatagcctcaccgatcaatgttgctaggtccttcaagttcaaccattcgttgacgccgatcactctgttgcttggcggagcgcggattagagcttcgacgagtgggcctgtgtcgttgacagcagagtagtaaggaaagggagccgaggccacagcgtcgtccatatatagaacaagaccttcttcggtcttaaacagataaattagtgttagacaacagctttcaagaataattgtttggaagaatcaatgcacataccagcttcggtctcatcatctcaccgaccgctctgacgagattttccaagtaaaacccacaaaagatcacattcgtcttctcccaaagcttcgggtggtctgagcgaaggtactcttcggcgatggccttgccgtcgaaatggtggcagttggaaatctttccaccgctgaccttcttagtgtaggcctggctgctcatgacgagcctctgaagcgtgctgaccttggcagccgcgtcgatgatgttcttgttctcgaaggtatcattctctttgctcaggatcatgagggacttgccagcagcattggccttctctttgctcgctgggtcctcgtaaaatacccagaagtcattggtaccgtaaatgtaggacgctccagcgaaagcagcatcgagtgaggcgggatcggcgaagttggccgccaccatctcaactcccttcgtggccagagcgagggatttcggcgaggatgggttccgagtgagaccacgaatggtgtatgggcaaggtgacttggagaggaagtgcgagacgactgaacctccttgagtaccagtggcaccgcacaccacaagaagaggcttttccaaagacatattggtaagagcgagatggcacgagacgtgagcgagttcagatagagatagagatagaaatgtgatgatggcttgtgttaaagactgataagttgttgtgaggtgtgtgcttgcttttatattctcaggagaccaactgatagtatatctgttgcccagacatagcgggagctactgcgcattgggaagcttacaaacgaaagccggactatggggcctaatcagtgacggacatgaggcaaatgacgcgcctgatgagtgtcgtgaagtgtatcaagccaatatccatctgctgcgcatgcccaaagcagactagaccccgctgggtcttgtggcaaacctcgactgtcagatcacgggtgcatcgccggatctccccatcgcttccacaccgagcttagctcccgcaagctgcgtctatgcccctgctcttttatacccgttatgactgattgcgagcattatcatgaatatatcgccacaaaaaccagggtcagaacccgcatggctctccgcaaattcgtggatagagctcagcctctcgccaacatcaggacctgttctcgcgcccgccgccgcgatccatgcctgcgctgagctcgccatccacaggccagggcgctcgtcgaacgggagagattcaaggaagagccaattcgtacagtacccgagcctgtagttatctaatagcatgaagaaggcgtacgacgacacaatggtacgccgcacgctttcgcagaagagccactgctgccatggagaccggccgtgtggctggcaggtcagcgcgctagtatagagattatctgtccacttggagagcacatccagagaatcttcagcacctttccgctccgactctttagaggagaagatgtacattgccagatatataattaaggcttggcaggcagtcaaggcttcttgaatgggtatggcggcgatgtcaatctgagctaggcgagtgaagtcttggaaggtcacatcgtccacaccagatcttacgaaaccagctagatgcttcgcgtgggtactatgtaactgcaactttgggtgaatgaagagggcgggctttttgtccttgacgatctccgggatagatgcgtagcccagccgaatgtaatcatatggctccttcttcccgggatatccgatgtgagggtctatgcctggagcgcatgactgcgacattctcagcagacaatggccaagtctgtcgtagtctttgagcttgagccagaaatcggaagccttccctgaatgatgattcgttgcatttagatggtcgagatcgtatacacagtcgagccctttctgaacacagcgacggcagcttggcagttggacgtcacacttccttttagagcggttgcagttgcggcaggctttacgaatgaccgtcatgttgcagtagctgaactagttgccgagcattcattgagcaatattgacgtgtatgagattgagtgagagcggaatggagcagaatccaagggaagcggatgttgtgctgagacaacagttgattcattaattgaactcatgacacagaaatcgaatcttccgattttggatacaaaaagcccaccgatttagtccatttctagtttagcccccacaggtcttcttgcgtcttaattggctgctttgagctgtcagcattttccattcacaagtccctgcattttagcattcgctacatgttttccaggaacttctcaggccaggcagaatcagcctacctttttcagggtccaagtccatggatttgtgtgtcagcacgcctcacttcctcgtcatttcaccggattgagtcggctggcggtgagctaacgctgccggcttatccttcaggcgaatacttccaccaaagttattggcacccttgttaatcgacccattgataaattggaggcttgatcttcaaaatgaaacatctgcagccaatacttagcgtttggaatatctcaactgactatattcacgacaagctctgttccgactgggaatctttggtatgcctggatacatgcagaattacatacaggacacatttcacgtatccgaatacttggctcccgtccaaattcttagacgtaagaatggctggttatcgactggaaaataatacaagataaacttagtatcttaagtgtgagtagaatgcagtattagttatgcttctttactgtctggttgataaaatccaaaaccgctctcagatgagcaaagagaggggactcctcagctggattttcataatctgtgtcaactgacacctccatagcatcaaacccgtggtccttcccaggcaccaattccagatgcgccttaactccgctttcggtcagcttttcgtaagctcgtttgctctgttcaactgagacgcagctatccgcatccccatgtaggagcacagtaggcgggaagttgtgccctaagaagaagtccagaggaaagaaagttcgatactcatctggcacgctgtcaaagccctctgctgcgatgtttgacgatatacccttgagaccggtcatgagctctgggtagagacctgcttcgtggatggcagaaatccattgcatccgtttatcagcgagatcctcggggaactcatattcacagatagacgctccactagccctcgcagcttgcaattcttcgatcagctcatctagattgcttaagggtggggctcccatgattgatgtgccttgagtatattcatcgctcgttaggtcattgatgccgtacacagataaaactgctagagggcgaatgtttcgcagctgagcggcagccgcgaaggccaagaagcctccagcgctggatccagcaagaacaatgcgagaactgacgttgtcagccacccaattgatggcactcactgcatctgcgatcatgtcccggccagaggcctcggggagtagacggtaggcgggtgtaatgtaggtccagccgcggcgggcgcaggcagtggtgagccatgttggcgggaaggtttgttttccacccaaaaccttttccagggcatgtcagcgtttatcatgcttacggtaatagctagttggacgcatgcactcatacgaaaaagccaccatggaagtggacgaaggctatactctccttggtcacctttggcggtgggccatggagatccagggtcagtgccaggctaccagctgtagcgaaagtcttcgtttcgaaggatgtcatcctttgttgatatggcagcgttggttaggaatgaggggtgttctccttcaagaagggtgccttgtggtagagaattgtctcagtattgcttttgaatacttcagagataaccggaattttatcagcgctaaactttggcacactagatacaatcgatgtgatcattatagatttattgaccgacatgtgatgcggggcgcttgtgatagaaggtagttacatcgcaaggcaatctttcattttgattccgagagcccgagcaggtttccatcctttccgcgcagccgagctttcttctatcttccccgtcacggctcgacatgggaataccccgattcgttatagctgaggataattatcgccaatcaatcaatttacctgccaacttgatataagagtctcccaatcggttttccgttgagtccagccacgacccagccactttgaataaatacagtagttcttcctactcttttgaggaatggcaatcatttagatcatgttctgtttatacttatccactgacagtgacgtccatgtcatatgctaccatgcaccccgcattttattcgcgtctcctcgagataccatctctcaccgctctatatagagactactcgatgactgtgaacttgtcgctggtcctcactctgtggtttactggctttttggtataccggcttttctttcatccgctcgcggggatacctggccccttcatctgcaagatcactggactgtggcgcacttatagatatttcaacatgacctggcatgacgatattgtcaatctccatcgggcttacggtccggtagtgcgcattgcacccaatgaagcctcgatagtcgatgccggtgctcaaaaaaagctctacagccatggctccaaagcaagaaagacgtcatggtatgacacttggagcacttctgttcccgtgccggtctttttcagcgagacggataccaagatccatggtgcgcttcggagacgcgtgtcagcggccttctcaatgtcatccatcctcaagtacgagaagtatgtgcaatcttgcttggatgtctgctatggcaaaatcagaaagcatgccgaggccgggagaatcatcgacatgtcggaatggacacacatgctgacctttgacatcgtcggtgagttgacttttgggcaagctttgggtcaaatggaaacagagacagatctggatgatgttagaaaaacaaacacatcagacatatattgggccggaaaccttggtcatatgtggcttcagtcacgatgggtaaataacctggtggttgaatggctcaatgcagggtcacctgcagcaagattcagtgcttgggtctttgagaaggtgataatgagaaaagagggtcgtgatggctctgatagagaggacatgttatcacacttcctgaagatgaagcctttggggacgaaaaaggcactcgaggatatagaagtggtggtagaatcagccaacgttgtgtttgtctcttccctctccactaaaccccaatacctctgattacaggatatggaacttgctgacaagaaccaggggagctggagccgacacaacagctatcggcatgagaagttgcctgtatttcatcttgcaaaatcccagtgtgtaccagcgactgcaaaaggagatcgatgactactatgtctctgccaatcttcagcagccaatttcatttcaacaaactcaggaactcccatacctcaagagtgtcattgcagaggctactcgcctctacccatccattgtctatcagctattaaggcatgttccagatggtggcatggaggttaatgggcatttcctccctgctggtaccccagtaggcatgagccccatcgctgccaatcgagacaaggctatctggggcgaagatgccgacgtgttcctgccagagcgatggcttgaaaatccagagcgatcgacgtatttagagtcatacaacatgacttatgggggtcatggctctagggcttgtattggtcgcaatctcgctcttgtaagtactgattaaccatcgagaaaagcacctggctgcgagggtgactttggtaacaatatacaggttgagatgaataagtttgttgcccagatgatgcgtaatttcaatatggaaattacggaccgcagaaatccatggaaaataaagacttactggtttatggatcagctcgagtttaagatacgtgtgtttccaagagaacacaaaatacttctataaactaggcttaattaatacttataaatgtatgaattatatttatttttatttggctcttagacataaatggaattttaatgataatgctacctaatatctagaaggtgccctagagagggttggctcttgctacaggatggctgtgtacaagagcaagtgtggtgatccttttgaacagggtgaaatccagaaatcaatatatcgccttccaactggtagagtggcaatttttttcacaccttcccaattcgcttcactcctacttcaaatagttaatatataactaataaataaaactagctgacctatattctctatatataaaatcaaggagagttttctccatgatatcccgcctccaatggcatcgacgtcacgctccgacgtggttctacatcttccatctgctctagtcgttcacttgacatttatgttaacattgatcagcgggatgacctcggttgagcatcacttctcgctgcctcgtattgaaatgaaacttgaagcttggaattatcatttgaccacgccgctacccccgatggaacgaaaaacttaggcatagatgcaaagctgccgcttcaggggggagctttgtgaaatatagcggggggccgccttattaagtcaccaggcgagaaacctgactaaggactgcctgagctccatcaaacgtgggaaaagcaccatctatgtacccagttatgccagttcaatctgcatatttcaaatccgccttcggccagagctgctggggagcctaaaacaatacccagggttccgatacatcatggaagcgcaaaaccatgttacgggcctgcagtccctacctgttgagatcttacgctgcgtcatccgcctcatggacccaattggcgtgttgtcgcttgcgcaggcgagctcgtacttccgaaggatcatcgacccaggcaacatagagcttggagagcgattgctccagttagaaaccatacctgatcacggcggtagattgtccttgccaggtgcaggattcaggcctcagactgccacccgagcagcaacctctgtgcgggacattgacctggcaggcatgagatgggcttgcatgggatgtatgaggcttctctcacacatccactttgacaaccactccttactcaggctcaggtttcgcaagcccatccctgggactcctggccataaccccatcacatcatgggacttgggccgatacccttcacgggccaggcctcgtggacctaaatctaacatgggccgcggtgatcagacagttaccgacacgccagagcccaacccagacgctgttgatgatgatgatgatggattggaaggagacctgcatgaagcgattggagttctcaatttattccaagacttccagaagaagcgagagctgatgcgttggggcacgaagcgccatctccgccgatgcaacgagtgccggttccaaatgggccacgttggccgtcggcgaaaccccctcaccggatcgatgaccattcctatacagatgagccggagagttctgttcgccgatgccattgagcgatatttcccaggctatctagactcgttaggcaaggaaaggccacttcccgcgccgcccgtgctgcgatggttaaatccctctcggactgactacagctggaccatgtgcatgctccgatgccccaactgtgggctgtggcaagaatggagagacttcatctttgccaacggcgtcttgaacttgcccggtatagattatccgctcaacctgcctgagatccatgcccaactttcctcagagttcacactctgtaatcattgcatggcggagaggcagggccgagatgcgctagggcagcgtctgatcacgggcctgcgctttcacctttctcaaaaggtcatctacatggtccagaaaattgaacgcggttttttcttgatgcgcatgtccctcggcaatgggcagacttaccgcacgctcagtggagaggataaagctgagatgaaaaattgtatggagggtgtatttcgcgggccaagcacacctcttcggtctgatgcggagaggatgggaattctgagagagcgattcgctcagctaacggaattctttcatcaactgcttgctaagtatgatcttgaggcgcaactgagggacttcagtatgtggcatgagctccaactgtggatagagcattaccacaactatgagagaacgttgggctgggccaaggatattctagatggtggcgacgtgttgacctctgatagcatcgttgactgggccttggatcgagatggggcttctctcagttgaaggttcattcgtgtgggtgcaagtgagtctccgtaatcagcggtcttgaagtcggccacttaacataaacactttcagaaggcaacagttccgatataccttggctctggttgtataagtcaaaattaatattctagtgtaactttaaacaatatctatttttctggtacagcttcttttttttccaaagtctccttattctgaacatcagtctgggcagctttctcaacatcatcgctctggtcaacctttggaatcgtctttgcgtcacttcccgaaccaggctgagttgtgactggcttctggcgaataaagaacccagcgatgagcaacaatccggtaacgcccgtgtagaaagcccacatgatatgcagcgcattcatatactcatccttgtctatcccaccctggcctccgctggtgacgaaactccccgacttcatgcttctctgcatcagcaccgtgccaataacgatagacatggacgtgaacaggttgcggaggaagctgtacgctgccatggccattgccgtgtcgcgctgccgcaggtagttctgcagcgcgatcatgggactctggaacatgccgcctgcaccgagacctgctacgatctggaagaggatgactttgggccagttgacggtggggcctaggaggatgaagaggccatttccgagacacatgatggctgagcccccgacgatgaggaacttgtagtagcccgttttcctgatgatgacacttcccgacatggttgccgccgagaggggaaagatgagggcaaagagggtgacggcagagatgattggcttgaattccagaatcatctggaagtagagcgggaggaaaaagtcgaacgagatgaagacaaaggaatgaaggcatgcgacagcgtaggcggcaatgttgttccgctcttggaaaacgcggaacgggatgatagggactttggccatggtggcttcccataccatgaagagagcgagcaggatgaagccgaagaggatgaggcagatgactttggcagagccccagggggacaggttgctcgcgccgacttcaaggccgtacaagaagcagatggtgcctccaataacgaggacgaaaccagtccagtccaggctgcggataccctcgacaaaggggaccttcttgatatcgaccttgaggaagaagaagatgaacaccaaggcaattccatcgactggcaggttgatataaactaaacggaggattgtgagctaaattgtaaaccaacataagctgagaagacttacaacaccatctccatcctgccgcttgggcgaagacaccgccgagaataggaccaatagcagcggcgataccccagaccatgcccgtcatgccgtaatacttggcgcgttcctcgagcgggaagatatcgctgatgatgaccgtcgtgagtacgaacgaccctcctccgcccaacccttggataacccggccaccaataagcattgtgctcgagacagaccgcgcgcatactacactacccaccatgaagaacgaagcagccgccatgatgatgggcttccggccaaagatatccgacaccttggtccacaccagcatcgacgccgtgttggccaggttgtacccgcttcctacccaggcatactgctgcgcgtcgatatgcagctccctcgcgacggtgggcagcgcggtggagatgatggtgatgtccagcgcgccgaggaacagggtgaggcacagcgagagcatgaccaggcggcgccgccacggcttcatctgcatgcccgtgtagttggccgcgtcggtactgacgactaactggaggcccggatcggcagtagcgccatcggcaggttcctcttcctccttgttggcggccgccgtggtggtagtgctgacgggatcagccttcttgtcatggtccctcatcgtgctgccattcgcctgaccctcgggcgggctcggcatggctgtgtgagggagggaggggggaatactgcgaagagaggcaccacgaagtcacagaccaattacgaggtttggcattgagatcgaaattctgtcaattgaaatttgctgcgagaaatctatgggacaaccacgaagctcggaaacatacgattcccgaaggccgaggcccagtggggagaaggatgaagtccgtgattggtggttgtggacatgggtctgccttttcgatctcataccgaacttttcgatgaacaaaacttttagagaatgatgtgtaagattaccctctttgtacatcagtctgttcgagtgctctactaaaccgcaatgctgtaggccacggacttctccacgtcttcgagcctgacatagtccgcctgagtggtggcacctccacggaacacatatccgaaccaggtcctggtccttggggagccagagctgatgcctgcaagagccatcacaacaggctgattagctggggggtcgtccttgattaggaagaaggccattcctggaacccacctgagaatgacagagaggatgtgcactctgcaaaggtcttgcatttgtcctgcacaaatttcgcccaatcctcggcggtgtagtcacacagatcgccattgtagccggcaatcacgttgcttgggaatagccgagcgcccgcaacccagttctggggcgcttccagcagcacttgaacataagtattggtattctgaacttggtttccggtttctgcgggggctgcgatggctcctagtccgaggagggcagcgggaagggcgatttgcagcttcatattggcgcggtagattcacagaaagatgtcaaagaaagaagtggtgagttgattaaggaatgagatagagtccagagatttgaagcagatgaaagaggatgtcccagacattttaaactggcctcgacctgagataatcgactcacttttgacgtcattagcctcattatgtttcgtcgctgaagcggagaaatcttcaagaaaccttgtattctcgtggttgaacttagaagcccaccgcgaaataaacacagggacatctcagacagatgggaggctgacagcctcttctcaaagagcgatcgatcgcatatggccaactttgacgcgtgtgagagttcaaacacacagtggaaaacaacactagaagatgttggacccaacctccgaagatcaacaacgcggatgagagagtttggctacacagtaaaagacggtactagaggattttggatccaacctctcaaaataaacaacgcgggtgagagagtttggctacgcagtaaaaaacagcaatggaagaggccagacccgacctctcatcacaatgtatagcaaaaggtgacaataagctctactggccaaaggctacagcaatgcaaaaggaaaattctgtaaaccttgatgccaataactccctttccgccgggacgaaccgcgcgtcaggtccttgcccaacctccctctttcatccacgtacctgactatcgcacacaaaacgtcactctgatgttctatccaacccaaagttcaaacaccaagcttaaagcaacctagcgagtaccagtagccccttggccagagcgcttgtatgacatatgggcagcgttagctattggtcctggcgacaagggccatccaggaccaacttgacaataacctcagagaaagagagatgggtaggtaaggtacttatagatatataaggtataagcttctcttctttatagtagaccaagacaagctattccacagcacgcgttagagccacaaataccacgttagggcatctgttatcagggaggtcgcggccaaaatacttgaagtgccaaggtgaagccctgttggatagctgaatgcacgacgttaggtcacaagagtcacgcaattaggtctctgatgataatacattaattcctggccgaatatagagggttttacatgaatcttgcttattaaataacaggtcctcaagggtcacacctgatctatcagctgaccattgacggtttctaaaagatagcattgacatatggtcaagtgaacatcaattttcaatttgcatcgcgatttagtaacctaagaaactactccctcaacatacagagcattatgcccgagtactcctgctcggtgcattgctcacttcaccttcctttactatctacttgagtaacccagtcatattctgcttttcaatcagccagcttctgaatgtttctgcatcatctgtaatgtttttaaccccacattgtgatagttccataagccgctgcagccaaaacgtccaacgctcagttcgccatgagcgcttgccctaaccatgttgttagtgcaggtttttttaaccctgcccgtgatactaaaacagtattccagctgaccaacaatggtgatgaaaaactttatggcaccatcattgcctgcgttaggacgcatattatcgatccataaccgtggttttctttatcacgcctgaatagggaaactgggtcgttatgacatggttccagcttgtatttttaggtagtgaaattacttgtcctaaccttaagtcaaccaacaactcaactacgcggtaagttatggaatttcaaaacattgagagcctatggcagaaaaatatatatattagtggctctcagtctctccatatcccttctcctttgttagaatcaataaggatcaaagcaattatccgagtctaccatacaacttcttcatcttcttcatcaaaatcaagttatctatttttcttcttggcctttttgcgtatactgccaacgcagataattacaagcgtgtggatgctagaaccgacctcaaccagggacatcaatacacaggtgtacgtcaaaccccaatactccccaaatactgatttccattccgatacaccgagttgattacttctaagtgttatgttttaatataactctcactaatcttcactttaggtttgcaccgccaaggacggggcttgcagtggcctcaagtattggcaggtagagagacatattccagcgaccaagaagactggagcaaaaaaagagtgcaggctggtatctatcccaggagggcccttaacctgtttcacagagagtggcaaagctaggatcaagttagagcatggaaaccggaggataggaactctagatattcaagatagtctgttgagcttcatcagcaagcttgtcggactctatgctatttatactaataaagctcggttaatttactgtacagaataagtatatattcgtatatccatcctttatcccagtcggtttgtaactataagcctcggagactcttgtcaccactcgtacccggattccctggtatagggtaggcttatcgcgaggggttgagtgatccgatgctcgttatgattttggcgctactgcgtgacaacctgccaccctacaactaaggcaagtaaggaaatagcagatcctcccggttttcaacaaatgccccggaacacactaaactactcggccattcctaatctaacttaatactactactatagtcaactgcaaaaggtaccccgtgttactggctttacaataacggctacgcctattgtacttagaattgaagaggagtgcatttgatagtgttgagttttctaagttaataggatctagagtagcaatagcactagattgattatattttatgctcacgggggcgttaacacgtgactccctccaataggaagtacacttttgcagctagccacaaccctccaggttatccagtcaccctcagccatcttcagattcaatcatgttattttccttagccaattgacccgtatttctgcctaatcccggcaccatagcgatggaccacgattaccggaatagttgcaactgccacaattgcagcctgcgtcccgaagctcgcatcggcaccgactctctccgaccacggctgctggaaatatcccaccgcgaacccgccgacggtcctcgcaaagttcagccacccactaagttccgccggaactgttggatatgagtctagcgcgtacgccgtgacagccacggaattgatcatgacaccagtcgtaaagatgcccagaccgaagataacagcgatgagcggtagagttctctccagagactggccaatgagtatgagcgcaggaatcatcaatgctacggagacgtagacagtccagaggcggacctcggattcgaaaacgccattatggcgctttacgtagcgacgcgccatgtagtcattgaagaagtggccgaaaatttcaccaatgaatacaccgcctatattgacaaagtagacgtagccaatcgtggtggtagatagaccatagccgccagcttcttgaggcgttgctagtaggaggttcgttgagatattgatgccaattgcccaggcgaagcagaggaagctaagaaatcagtcagcccatgatcatacaagttgtgccttgctagactcttactatgacaagcatatcagaaagaaagcgggcttcgtgatcgtcgagaaaaaacgtttacaaacggaggcagtcgaagggaagtaactactatggtgccggactccccagaccccagtcagtctccataatcgtcctaggcctccaggtcgtgcgggctgttgtgaatcaggcacatcgcgattgtaccatgtctcatccgcgaaagctagcacgagcagaagctggatgccagcgcatccagagcacatccagtagacatgtggccagtggtgcgtcgccgcaatgatgaaattggcgagacagggtccaagatagggggaggcgatgtagagcactgcccagaggccgatcttgcgagctcgttcgtggaagaagaaaatgtctttgagaaaagcaatagatatgacttggccgctggtgaggaacaatgctgagacgactcgcatagcataataagtttcgtattcggtcgagcatgcgctgccgatctggaagccgaagccgaagacggttgtccagaagagtacaggtccgcggccccagatggagctcactggcacccagatcagaccaccgataccactatcagagttgtaagcgtatttcgctagataatcacttctggaaattctttacttgagaaggaccgctatggcgttgggatcatttgctcgaccaggagtgatgtgccactgcgcagcctgcgggaagataatggccgacccagctgctgcggtgacatcagctgtcaatgcggcccatgcaactgtaaaaagaacaagatgctttcttgtccacgaccaattcaaagggtcacaggtgtgatcggtgggttgaggaaggagcaccgtctatatgagaccaagagttagagatgacgtccctagattgccaagaggagccagctcacatgtccatcagaagcaaacttgagagaaacttgttcatcttgcctctcgagaccctcggcatccagcaacaaaccgccatctctccgaagagagtcgggaagcgccgtcacaaagccagtagacttctgagactcgtgatgtgagatctcgggtttttcgttcatagctgccggctgttctctagaatggcatttgtaattgaattgctctcaagcaaatggaccgtgaaggcaacggtatctccttttataagctttgttggtgcgcgattctacctacatgtacacaagagcgaccccacgggggacaaatccggggtagcaagaaggtggattcgcctacaaggacctgccggatctgattccgttatctggactgcgttatagtgcctagcagccatctacattagtcgcctgtgctcgtatcttcggaatacagcggcgcatgagcttaaatttgatatcttgcttcttcacagctgtagtcacacccccgctccgttgagcgacatgatatgatagccaagctcttgacccccgtggtccagagcgatgcttggatcccgcccgagatcttgcttccgagcaatccttcacctgtgaatatgctcatgcaacttctttcatgacaaaagctactgaaatctggacctccgaagcaagcttggatctattgtccctgctatcctgccgccaatgagcttggcgctccgctgcattctggaatagctcgtcatagtgagcgcgtcttgcttgttaaattacagtgaaacctcgagtatatactcttatgctgctcaaagaacatcatcgtgagaacagtttgtggccctagacgcatgaaacttgggaaccatcctttgaatatccaagcaggcccttctctcaacgtagaggcccgcaaaacattccaagccccctgcggacccgacgagctcataacgcgcgttttcaccacgtccacgggagaacatattgtcgttgcgaccatgcccgccacagctgaagagacgaggtgatttgccgtactatctcccatgccgaaattgcggcggacgtacgatttgcatatgtcataggacgctagttgcgatgaattcatcagagctgcacgtgttgcattggcaccaacccctcgaaagaggccgctaagggggccttctttccttattatttgcaccaagccatcgaagacgtgtctataacttgtctgatcccggagaagcttagctttgtctgattgcatcctcacatttacaatatcggctggattaccaacaacaccggcgatgaagcctgagaacgcagaaagagggatcagcatggtacccgaacccctctcgaccggtctaccggctctcaatcggatcttcaagtcctcatagactccaaatcgaacggttgagtatgtcatttgacgaagtagcgctgcactgaggcctgaatagagaccagtgaacccctcggtgagcagaatgcgatgcattgtaccagacgtacacgcttgctgtgcatttggggttgcttgtaagcggaccttaactatgcaactcgttagatcatttcggcgacttggaggagctgaactaaccaagatccaagggatgcgtgaacaatgttgccatggagcttgcactgccgccgaaccagaacggatattccattgcaaggaaatatgagggaaattaggcattgatgggttcagtcaggccataatcaacattcaggatagaggcgtgtccacagtgatcaagtcaaaatgcaagcatctactgccgctatctgtcaacagccatcataggttagagctgccactttatgatttggatcaaaccgaatcaatccaatatcgctcttgccgctgctcaactcctgccggccttcggcaaagtgtttaaattttctcgcgattggcccgtgggtgatgggtgacaagtgcggtacagaatccttctaggcaagtttgcggttttcgcaggcggcttacctacgaggaaccaggtccgacggaagatagtacaggtccggattttttcctttggtctcatggatttgtaaccgcagtgcgcaaggcatcgcatatttctacggtggccaccggagcctgtcccgaaacctcggaaagggtccgccacccacctacaaggctacagttatagacaattcatgaaccatagcgacaatctcagtgctcaaacagtgacctgttcggcgtagccttttttgtgatttattcatcgactaatgtctgcacaagcctggaaaagactgatccggtttgcggatgacaatggaagggagatgtttggggagccttgtatacagtcggatcatgagctcgagcagctgctggcaagtggcactcttcatgcgattgaatacaaaggtttaggcccttttggccttacgacgcgcggagagaaagtccatgtcaaggctctgcgaaacatcttgcatccatctgatgtcccaattattcgctgcatcggactcaattatatcaagcatagtgagcgctaaagtgatcctgttgaaggtttaaccacaatttctgaccattctttcagtcgaggagggagggcgcacaccaccgccatatccttctctattcatcaagccatcaacatgtattgcaggcttcgaggacaacatacctattccaaaagtcgcgcaggatggcacaatagattacgaaggcgagctggtaagatttgaagagaggcagaaagcttcaagtatgagatattcgtactgagaattccaggccatcatcatcggcaagaccgggaagaatatttccacagattccgcgctagaattcgtcgccgggttttgcgtatctaacgatgtgtcatgccgtgggtggcagcgtgatcccaaaaaagccggcggtgtacctcaatggtgcttcagtaagggctttgatcgatttgcacctttaggcccaatgatagtgtctccagatatcattggcgatgccgctgatcttcatcttcgaacactagtcaataatatagagcgccagagttctagcacaggtgacttgctcttcggggtagaagagattattagttttctaagtcaagggacaaccctggaatctggcacagttattttgacaggaacgccatcaggggtagctatggggatgaaggagccaaaatatctgggtgacggagatgttgtagaggttagcattactgggcttggtcgcgtcaggaacacaatggtatttgaataacgattcttattggtcattgtgagcggtcgaatgtttttcgtatctgcaaagggtgaaagcattcatatctaagtctatttattcagtgtagagaatagatggcttgtctaaaggtcatagtgccgcttcctaccgctaaaccagtgacttctcatgacttgggtttctggatgagaaactgaatgctatgattgtgcaggatcttgagatggatcagttgatggtaacatgtttattaaatagctcaaggatagaatagccccatgtgggagcttttttgtttgactgccagaacgttgatttcatcctataattcctttatgtagtacacaagacaagtaatacaggtaggcaggagatacctcagtcaaaattcaacagtttgagggtttcaacggccaaaggtctgagccgcagcatcttaaatacagtcctttttcatcactccattacagaatttgctttctttccttcagccggacgtagaattctctttgtcgcacgaaccaagcattatgcgttttccaagatgcttcagggtgagctaactcgagcttgaagtccaaaaaatcagcttgtattcttcctgttcattaaacggtttaaacatgactcacctcgaatctccgtaggatagcagggacaagcttgtataactctagaagggagatgttcttgccaatacaagttcttgctccagcaccgaaggaaaataaagtattgttcatcttccgccgctgttcagtggttgcttcgagccatcgttccgggcgaaaatcggctgcatccttgccgtacacatctgtactttgatgaagcacccacgcggagcagccagcgattgttcccccaggtaaaaagtagcctgctagtttgacaccgttggctggcaccattctttccaacgtgaggcccactgctggatgacagcgtaaggattcattgattacggcgcctaggtacggcatgtccctgacttcttcccactgcggaaggccgtcctctcgggagaaccccccagccttgctcttttcagagatttccgccaatagactattcatcgtggagggatttttcaacagaaagtagaaaacagctcgcatggtgataccggtggtgtcggacccggcaaacatattggcgacggtgagcgccagaacaagctgctccgtaatgaagtcaggatcttttgctctggcttctttgaatctgttgaggaaatctcctcttctagacttttcctcgcctaaagactcatcgttctgacgcttagtgatgtgctttctcgcaaattgcgcgacaggtgcactcgtattgatgagaccgctctgagctgcccatagtttgagagggttcttaataaggaggttgtccaaaaaaggtatttgtccgaccttcaggtgattcattgagttagcataagccttggcagctgtgagtcattttcgactctgagggagcttacccaagagacgtagtcgaggaagctttccaaatcccgaatgatattgtcgacgtcagcccctttctctacgaatcccagcctcttcgagaatgtcaactctccgataacatcaaaggcatagaattgtagccaagcaccgaaatcacatatgccatcttcgccgggcttgtctacaaatctcgtcttgagctgtttgaggaactcaattgaggttgagtcgacgaatggctcaaaagcaaccaaagtgctcatagcatatgaattagacacagatcgacgtagctttgcatgatacctgtcgttggccgtgttgaacatggtctcaagccttttgcccttcgcaagagcttgctgcaccggatagaattgagactagatgatgatcagtatttgaccccacaagcttggatggacggttcgtgaattacttttgaccatccagcactagggctgtaaatggtcttgattgcatcaggatcggcaatagacaccactcgtggaccgagtctcactatcggtccatacttttggtgcagcgcgatgtgctcttcctgcgcgtgacggcggcggacgagaaacagcctccataagtctgaaaagcctgctatccatggccccgggatattgtgcaatccatgaccatacttgttgaaaacttcacagaatagaaggcccgctagcagcgcaagtccaagaatcttcaacgagccaaaaccgaggtgttccaggatcatgatcgcggcgagagaatagattgtaggaaggttagacaatagtgtttcaatctcacgaagttctagccaaaaaaagtctggaggcaaataacaaacacttgcatgtattttgagctacggctagagatatcgcttttactgaagcggtccgatcggcccacaactccttgtggactcagacttcatcgtcggaaccgcaccggggacaactccgtgaattccgggacctgcacggaaacccctcccaaactgttctatcttccgtctcgactcacaataaggtagtaccatcagagttgattgaacatgtgacagcattcgacgtgtgtcgaaacctgtattgtctaggtcgtagcttcgttttccccagaggaagcaaacgcagcgtgtagcttgaggtgcaacgtaacaaaactattctgtcctgttgtcaaaattcacgatctgctcggggcatatctttgagccgttatcagggggactaatgcagttcgcctcgcctgaaatatatagatatataatacaccgcccaacgacatagctggggctaggacgctcgtggtagtatcacacactattctcttgctcgcatcttttgaccatatatatctggcatcatttgttctgcttcgcgttttccaggtgcggaaatatcatgatggctggcgactcaattaggtcggaccaacgcggtcctcgatcagtcagacggtacatcactgggcatgatcctagcactggacagagtatctacctggaagtgccagaactgaaatattcccaggtgccgggctttggagaggcatccaggtcattcgcaacaacgcaactaccagccaatctcgacggggattcggatctcaaagcatatctgtcgaaagacaccacggccagctcaacacgtggtgagataatagtacctgccgaagattttgttcggtatcccgagacggcgctgggaggcgcaaatatagtcaacttatctattgatccaggtgcgattggtcacatgcacagaactatctctctcgacatctcgacttgcattgagggagaggtgatccacgagcttgatagcggccagagagtcttgctcaagtcaggtgtaagtagcttcgaccttctacgagaaaatgtcagccgtatgtttctcttgtgcaacgctgaactaagaatcgcgtcttgcctttcaggatcacatcattcaacgagctactatgcatcgatggatcaacgcgtctgataccgttcaagcccgggtcttagctgtggttttgccttgcagcacgttccaggttcaggggaaatttcttcaagaagagcatatgttctaaatggcatgtggttacacatgtaatatgtgataagacaaagctcaattttatggcctaactgtggcaatgaggaaataaggctaagcgacggtagctttagggaaagccctcaatagatgtgattccaagcgagagtagtatttcccacggcagcgacaaactttctctgctccaggcttagtacttgcgcgaatgtgatgagcattactccgattgtttatttcacggagatgaatggagtacatatagccatggtttttcagggaggggagatggtagagtaacttgtgctcttactgagaatatagagtcgaaagtggttcgaaatcttgctgcatggcatctgtcgtggagctgttcaagagctggattgtccttcgacacgcaagcaacgtcttccgttgctcaagactgaagtccaacaattcacatagctacagtagtatatcattcattcctatctcgattaatttcattcagaaatttgagggtagttgaaactctttctagacatttgatcgaagagaatggctcgtgatgtttcatcttaaccgagttcaagctccaaaatgacttgttgtcgaatcccatacacttcatgaagttagtctacttccagttgttaactctttgtataaaagtaagtttgtattttaaagcaatattcacaagcataaattccactatctaagcgcactgcgcgatgccattctcatagccaatccgctcatgaggctttgcaacatcggtagctcccaccatctggggaaggtcactttccccatttatcaggatgtttgactcagtgctctttaacactccagccatgccggccttcttgaggcgggagagaaccgcatcgcggggattcacagcccggtccccattctgagtcgcagagaccgtcaacctgccatcgtcagcaacaggtactgagggcaaaacacccgcattctcgaaagcgcggaaggtctggacatagatctcaaagctatcgtcactccgctgccatccgaacttccgcgctttcccaacggaggaaatggtagaccaggctttgcccaggccccattcgacaaagtcccatgttccccaatcaaatgcttgggggctgccgccatacttggccacaactcgctcccatacaggcttcttgtctttggcccaatcgcgcatggagaagttattggccagttgctcgttgtcgcccaaggcagcccattctgtttgctccgggatctgagggtattgggatactgattagcatgattccatgtgatcctctgtgcattgctgtaaaaaagcggcaataagaaaaatgcgtacttacatccatgccaaagtactgaccgagctggggccagaaatacttccacaaaaacacgtcgccgttggtgtggttgaatgcttcgttgctggtgtgctcgtgggttgaagcccagacgctcatgtcggcaatgctaggggcatacgagcaatcatcggccgtctgaaagaagagcttgttccccgggaagatgggcgcttcgcccgtctcacggcaacaaagcaggtatatggccagcgtgagtgccatggacatgccgtttcctgcgaatggattgagttaactcatcattcaatgttggaattatacgctgtttaattggattatctacctgatggagtgaatccaatgatagcatcaggcctgatgatgttccaggtccaattacgctttgacgccaagtcaaacatgaagtcttcttggtcatagtaaaaattctccccgtgatcctcgtagcgcggcatcgtttccacgagaggtaccctcgtcggcccgagatgagcaccgtaatgctgaaaaacactgtaagctgcgtactctacaaatgaaagctgaggaacgggatacttggaaacataccttgccgcctgtatgcaggcaaactctctgtagcgagtctttggccacggcatcagtcgccgtcaggaagttcgtaaacaacggtacattgtattccttcaacttggtgaagtcggcttcatgaacatatgatgcaaaaaacgcatgagtcacatcgtggcaaacgggtttcataacctcgatcaactcatcgacaggtttcaagaagtcaatggcgacgaagtggatgcgagagtcctgccaataggcctggctaacgcagcgtctggacgtgatgacaatcttggacctgttgcatgaaacacattagtacaatgtcatcttcagatctggtgtcataaatgagagagctcttaccattctgacgtgggctcccgaatcagatgttccacaatggcgtttcctgtaatgccattgacgcccgtgacaaaggcaacttttccatgttgaagaggcatctttgctgacagtcgttcgatagaactagtatataaaatgtatgtgaagattgccgaagtcgtcttctaccgctcgtatctaacaaccgcagtaaagctgatgcgacaaatcatctactatatgcctactcatgtcacttttaagaatactttccgttggtcattatgctgtggggtgccctgcccggaaagcaagagattcttcggaacgcagatgacaagagcccgggctcgtaccccggattcccgaacgctgcggggttcaaggagagaatagccgttacttagcgtgagtgagagcatctgcttcacgctgtccctgtccgagaagctaggatggagtcaatccggtggcctcaacaactcactacgtggatcatgtgggcgattttgacggagcccagctcagttagaggtagaacatgaagttttggaaaaatatactgaatttagcaaggtactcaacgcctgcctacacgcgcgcaaaacatagactacccttaacacatctgaatcggttcgtttaggctacagtgccatagtattaagaagaccactgaataatcacccgagccctccaaagttcatcataggcgaattgtcgaagagatccatcaaagaaggatcattcgttacttccaggtcggtgacattgctcaaacccagtgctcccaatttgaactgcccaaagtctccgtccacactggcattacttagttcaaggcccccaagagactgatcagcaagcaaacctgaggatcggaaatcaactccgtagcgctcactaccatcaaggatggctctcaagtccggatcggagatcgcccggtcggttcgctcatccaagctagacctgcccatccatgacgttgagaagcgatgttgatcctcttcagtcgtatatcgtctctccgcaacattagctgccaggatacggggcttagccgaatgaccatccaggttccactccctcgtgtgctcaatcctcctatcatccgtcatgcttagtggcggcattgatgaatcaagtacttgtggcgggtggcacccctcttgatcttcagagtgtggcgttaattgctggtgcatgttcccaccaccagaatcttgtcgttcactagcatgaccatctgtcttcttgctactcaatgtccgctgaactagtctcgtcagcttcgacactagcctcatcatcttcccagagacccaaacttcatgacaatacatattcaagcacctagcggcggataataacaggtccccatatctcctcttaaaccctggctcgcgagagacgagtccaagcattatcatcgtgcagcttgtgacataatggctcagggcaaagctgtacttgatcccgttgtcgttgagcttttggtgtgctgtgagaacgctggctgccaagctagcgcaggcggttgccgactctagttcgtcgtcctcgcctcgttctacagatcgggacattggtatgaagggtttttgaatcagaacacggacatatgtgcagcactttagaaggaagtcagtcactggagatagtagcgtacatactgggtacttactgtgaagagaagcattgtctgcttaatctgccaccgcaatctattactgaactgaggttcacacggcaggtctgggtcgtatctcaaacagtcgggaactgcatctagaagttttcccaggacagtatcaacatagtctaccattgcggaagcagacatgctagaagctttgacgccgtagaggatttcccacgccttcgcagccgctcgagagtatcggatcagggcgatcatatatgggactgctgattcagatgggttttctgcaacttgggtcatgatatccgactggagatccgctactgtgtctggccgagtccgatatcgcgatagacagtcatcggtcagatccaacgggaaggccgtgtcgacgtttctgtcctgaatgagatacggcttgccagattcgagcgctattctgcggtccagcgcgtagatgacccaccagacacgacagtgaagctggttgtagaatgcgggcataggatcaagtgtgctctggcgatgcagtccagtagcatgcgcgatggagaccaagagtgccagaacttgcgaggcttgctggtttgcgtccaggcggaacaggtatatgacctgatagtcgaatggttagctcaagagactgagaaagggtagacatttgctgccggcttaccctgagtatcaagacctgcagtgttggcagcgatctggtcttgacgtctcccaactccatgacgttttgcaggagagccatcccgacgctatacatgccaaatcccgaagagtacacgccgctttcatctctcattcgtgaagacacgctacatcgccccaaggcaatgcaaaagaagacgagggctaatgagatgtgcttctcacgtcgctcggtcgtgtccgttatggaccagagagcagagtattcccacatctcatcaaaagtttcccatacggtaggagggtgaagaaatgcgtagagaggatgaacctcttccatgtacacggcaaggtcccgcctccacttctgctcgtcgggggcgattccgtgttgaatgagtatcttctctagccacccccttatctttcttgaacctgtttcgctcagagcaggatctagggcacgtacaaaagagctgggcgaagaatcatcctcatggtggcttggaccgtcgttgttactctgttcgagattcggcgtgatggagagttctccggcgaatgtctgtccttccacctcgagggccttctggaactctgtcgtcggcttacgcgcttcctcggcctcgtcagaggagccgcgccgccgtagaagctcatggctactccgagtgtcaacttcgatccctccacgactcaatatgcgcagttgacgctccgcactggcgaggcggtcgagaatctctctgctcagagagctattcggatcgccgccaatctcccagtcatttcgcgcttcgtgttttctaggtacgctgacgcaagtacgtttcttcgcaacacactgtccgcatggctcacagccatcgcactgtatggtggcggtttaatgttaaagtgtgctcaacgaggaatcgacggactggactgggccttcaccgaccttgatcttccgctgctggcaagatgtgctgtaaagagggtaagatgaaggtcctgtttatcatgtatggagccgacagcttaccaagctctagttatgtattttgctctcttgacctttttggttggtcgctcctcagcacctgttgccgcctcacacgcctcttttgatcgattgctgccacccgtgggactttctgcttgggtcgtcgaggcggcaccgtgaccactcgggacgtcgttctggtcctggccgttgctgacgctgtcttggttgacggtgttggaagacatgatgtttttggatcgcctctccggccggcaacgctgcgctgtttaagatcacagggtgagggccaagcaacaaatcaaagcactgttgcagctgatagcctcaagtaaacaccgaacaaggctactagaactccatttccaagggtttcatgctcaaagtgaaacagattcaggcgctcttcgcggatcaactggaggattagaacagaacagattcagcttgatccacctccgcaacagccccagcttcatcttctgtaccccgcaaagcctctccgccattccccagttctctagataagcgcttcgtgtttaggcttagcggcaacacaatgatgcttccccggctgtgccggttggcactattgctgcccgttgccccttttggcttgcaatggtttggtcatgtctcggcgtcctccgctcctcacggaattttaacggaatttccgggattgtgattgattagtcggccatgctctctaggattacttgccagcctcttatcaacggggctacagggtagtctactcgaatgaagcagcatgcaacaaataccactccaatagaatcatcagtcaacgactaaaacaaggccatcatggtctgatgatttcgtatttagctaacgtagcaatctatctgggtgtaacaaagtaatgcaaccagagtctcgcttatgtctaactaccaatcgcctgcaggccaagatgaggaaggagtctctctcttatatagtcctcggctgtgtgtagcttgactccaagttctgcaacttctggagacggaatccgcacgccgggatacattcccacatcgttgtagagctggagcatgatgtcgcggtcggcgatgccacaggtcggcttgaccctatacacgaccttctttccagacactaaagccgcctgtgttagaagccttttctttcgtctttacttgatatgtgcgccacacgcacctttttcaatgactgcgttgatatctcgcatggtctcacgagccccgcaagctaagaaatatttcccgtctaagctgctcttgttcgtttcccattgatcaaatatggctttgcagaccgctgatagatctttctcgacataaagtgtggtcactattgtcacgttggcaccttagattctctaagcgaaagggggtagagttccacaaacgttcagcatctggcccaataatggggcgtgtcatagtgatagtgtcgctttccttgtcataggcagcgtatttgcgaagtatcatgttctcgtagaagttgcccgtgcggatgaagcaacccttgagaccagccgagcggatcactgcatcaacggattgcttgcctatggtctgcatatcagtatgtattgcacaaatggggtttagagccttaataccctcgtacagccgcgtcatgaacttccctccggaaatctctctggagcttggcagcgtactccataagaagcacttcactccagccttggacgcagcttccacgatgtgctgcccttgcttctcctcgctcattgggtcatcaagaactgtctgcgagcatgaagtcaatatggtatcctagaagaaattgctggtcgagctgctaccatgtaccgtatcgtagaagtctgtgaccgcaaagaccccccagacaccccggaaagcgtccgtcagcgtagaaggaaccgttaagtcggccttgatcaggactgctccctgagcggcaagcgctttggctttgtccgagtccgggttacgagtcaggcaatggacagagtactgttcgggatgttgtaggagcagctttgcaatggatccgcctgagatcattagaccaccctgcgtggtaagaagctaggaagggcatgactatctcaccttgtgtgccggtggcaccgaggactaaaacggttctcgccatgatgaactgggggaaagtcgaggcccttgacaggaagacgtcacagtccacaaagtgatatctaatgagttctataatttgttgccaatcataaatttcttggaagtgcagtgagaggcttttgagcatgtcggatctctcggggtggactcgctgttccgggctcaaccctctgcgttccgtggattctcggtcgtgtataatcgtctccggcaatgtgaaggcgggacacggtacatcactcacggataccactgtaaaagctcccagtgcctctcttcgcttcacttagcacctacggctttggtattacagctactccactgcattcaactcgcaccagcaatatggccgatagatacctagcggacctaaaagtccgtcgaacttgctactcactaaaatccgaatctccactcagcgacagtcgtatagtcgagatatcccacgaggtagccaaacacactccaagctcttttaattgccagtccactagattggtcatcctattacgcgatgaacatgtcgagttctggaatctggctaggcagtgcttcgccgccacactacagccagctgcctacctagagtacgagaaaaagctgctccagcgtcagcaagcgtacggcaccgtacgtaaatatcttatcggactaaatgaaccgtattgatgttttggcagatacttttgttcgaagacttggacgtgatacgggaatatcagtctcggcagccccgttttgcttggcacctcccggtcttctcggaacacaacaatgcgatggcagcgttcaatctctggacggcgctgagtctcgaaggcttcggatgtaaccttcagcatatcaatcctacagtcgaccagagaattgttggccgttggaacatatctccacagtggtcattgaaagctcaattggtattcggaacacgaacctccccacgaaaaggtcttcaagccaacggaggacagggtattcgtctactctggtaactgaaattactatcatggggcagatagaacattggactcgctattctgatatccctactccacagagttgactgccgtgcttatccgtgcatattgtgagaagcttcacaaacggcacccgagtcgtatacggtattagtagagcggtagagagtttattcatgcagctaggcattaaatgagacgtatttgaatatggcacaacaccttcatcgataaaagggagttcactaagcgactgatgcttctgttagaagtcgaggctgaagatatgaattgaccagtagttcggtgattgtgaagataacctagaccttcttcatggctcttcctggtctccacgagtggagttgtcattccttgcaccatttatggaaataccaccattgcgacggacatagttccgatggtgctcggggaacgactgggatttccggggtctggtggcactaaggtgatcgatgaacaggacctgtccacagatcactaagctatgggagttttgaaccgcttggtctttttttctaaaaaaaaattatataattcttttctgatttagccacataagcaagcctcaggtgcaccaagggaggtccatccattcaacttgacaatatgcctgattggagcaaggatccattcatgtccgattgggacgaaaagtatgtgtcgactaatgtcaaagctggtagtcggctatatgataaaaaccttttcatctccttaaactccaagttggtggcctctcaccctgagcttggtggttttagtcatgctatcattgtgagtagtcctcatcggcctggataagatgtgtcacactacctggactaattcgaacgcaaacaggccgcagcgtgttgcgctctaggtcgcgccgacgttgtggggagattctttgacgacattacgagtgaggccagtcctgaagattcaagagccatatttctctgtctgagggaagccatcacaatcatctttccgtatgtgggaatgccgacttgcattccagcctgttatggcatgattggtgtcgttcagagaaaagggcccgcgtacgcctctacggaggttctgcgtaagccaacaattgacgaaaacgatgtggcaaatggacgagcgctgcgagccaagatataccgcggcgtgggcaattcggatatcttcagcctaatggacaagtacttcactgatctctgtatgtgagccgcatgatcctcagacctagctgagaactgaccacctcgaaacagtcacttgctcgacttcagtcacctggggttacctcatttccaaagcgaacgaggaagttttccagccaaatcagtcgcatttgatcgtcgcatctgccattgcagcccttggggccactcggcagaccaagagtcacatcaaggcaacactaggaatcggcaattccgtagcttgcgtcaagagtgttctggccaccataacgcaattagcgggttgggcggatcgttcaatcgcgaattttgacgtggaagcactttcgttggagattcaagctgctttagcaaaataaatgtgaatatcttgttgaatttgaggtacatttgaatcatcttatacgcccgtgtcatgtgatatcggcacggaaagtttgcaaatatttcaccaaggcataagataaacgcctcttaattttccatgtacttttaatgcgcaagccctcctaaggggcctagactaactattctaaacccttgctgaagcatcttaagtcactacgccctcttccctaagaactgcaatctctttcttatcaagccctaccatctgctccaaaacgtggtcggtatgacggcctaaagttggaggtgcctctctgattccagggctcgactcggaaaacttcaccggtgagttgatcaattttataggtccacaagtctcatgctggatctcagtcaccatgttccgagccaaaacttatttgcattagcatactgggttcttacttctctcagggacaaggaggaacctaccgtgctcatgttctagcgtactcttcacatcgttaatagcagcgtaagccatgccgctattctctaggatatcaagccactcctttgttgattttgtcacggtcacttcctcaataagaggctctagtacggctctgttagcaacacgactgctattggaagcaaaccgcgagtcagtggcccattcggggaaccctagccgttcacaaagtatcctaaataggcggtcgtttcctcctccaagcatcagatctccgtccaacgtccgaaaacctcgatatggcacaattgaagctgcgagggtcaggttcatcatatgatcctaaagcgtagaatattgaaaacttacgatgagccgtcccccaccttccagaatctttatcgccactgatcaaaaccgagctaccaatatttgcaagtgtggcaacctgacagtcggacagggcgacgtcaatgtgctgcccctttcccgttctttgtctcaggaacaaagccgcaagaatggaatgggtagcatacaaccccgtggtcaggtccgttaccgcgacaccaactttgacaggcggcccatccctcgacccagtgatgtgcatcaatcccatctcggcttctaccatgacatcgtagcccgcacgcttacggtaagggcccgtctggccgtacccagtgatgctggtgtagactagcctcggattgatcttgttgatgcttttgaagtcgagatcatactgcttgagggagccggggatgtaattttcaaccagcacatcgcattccgaagccagcttgtgcaagatttgtatccccctgggatccttgaacgaaaggcccacagacagcttattcctgtttacctgagtccctgtcagaatactttgctcgtgttgcgctgctgtgcacgcaccgctagaaagtacgcgctctctcctggggcatgcgtgccaacgcgagtgctttttgcatacggcggcccccaagccctggtgtcatctcccctagtaggatgctcgatttttatgacctccgcgctgcagccggcgagcacaagttagcaaacaagtcgaggatgaagaagaagtatctgatgctatgcggaggaagtcaatgaattcaccctagatcggcaagaatttgcgtgcagtatggctggtggaatatcatcagctttcttcttcatggtagactaggtacgtcttggcatgcataccccagcaaggactctcgtcatatctaagacgcgtattcctgctaatgggagaagcccatcggattgtcgagaattcgtccacagtgagcgtctagactgatttattatggatgaatatctgaatcttgccatgtttttctaatatttgataacaactgctagagcaatgcggtttcctatgcgagtaataaccttgaataatccagcctcgctttcaaattggcgtagaatgttgaagacctatacatgtaaggtaccttcagcacacgatcaaacttagcgcatgtccatgttccagtgttccagtatctttccgtaagccccgttagcgctaattaaatgcccggtagcgacgggagttcattccagagtaagcggaacggttgagcaaaactcggctacacagattccgctatagtttcggttccattaatgacggaactgtttgaagcaacaatacgattgttggagatggcaatgtggcacggtgaattaaacggatgacaatatgcaatattggatgggcaattatgttctagcctccatagtctagctctatgatggagttgtgcgatggagaagttactattcggagctcactctctatcaccacaccactttgttgccctgcataagaagtctttgaagaagtggcctacgtagctaaaaggcggaggactgctaatgaaatgcttgtaaaccggtgatgccacgacctatgatcaaggctggatgctgttagcttatacttctgttgcagccacatgtcactcacaatggatatcagattgcccttcataggtctgaacgacaaaaaggttggctacgtggcggcctggaacgtgttagcttttgagaataaccatagccaagcaggcccattgatcgtaccaatgtgatactcgtctgacgccgcgttcctaattatatgttaatttatattcgttgaattaatcagttgggtagtctcaccctccaaagacctcctggagcctacacttggttagcatcgatcagaccagcaaagaggtaattgtctacttacgcccgtgccccagttagagctctgtcgcaattttgcctctttatcatggatatcatctccggtgccatctctccatcatccttcagtcttcccacgtgaatggccgccaatgtcccgtacgctgcatccgtcagcgcatcagccaatttcttctgaatcaactgatagctcgccagcggcttcttgaactgattcctatcaagcgcgtacgtcctagcgcggttaatgcaatcttccaatgcgcccatagtgccaaatgcgattccgtagcgggcggaattgaggcaactgaaaggccccttgaggccctccacttgaagcatgttctcggcggggaccgggcagttgtcgagcaggatcatgccggttatggaagctcgaaggccatttttgtgcttgagagagggagtttctagagtgcccggcggacattccctgcgctctatcagaaagcctcggatcttgcccgttgtctctagctttgcccagacaatgagcaaatcggcaatgggagagttggtgatccaggttttggaaccagataacgagaagtaccctttctttgtggggtgctctctggcaatggtctccatggatccgggatccgacccgtggtttggctcagtgaggccaaaacacccaatcattgtcccatctcggagctgagggagaaaacgatccttttgctccgctgtgccatgctcggaaatagggcccatgacaagcgagctctgcacagacatgcctgatcgatatcccgaatcgactcgctcgacttccttggcgatcagaccagacgcaacgctgctaacaccagcgcagccgtgagtgggtatggttgcaccgagaagtcccaagctccccatctctttcaagatctcggaatcgtagtcttcgttgcggtacgcatctgaacataaaaagatgagatcccagagcttgactttgaagagaggccaggcctaacttaccgagaacacggggaagtagtcgctcctgacaataagccctggcggtctcttggatgtccagttcttccggtgtgagcgcattcttaacagacaaggagtcctcccaattgaagcgcgccatcgaagatagcttctgacggctaggcaaagtaagcctgcgtgaactaagccgcggcatctgccgacacaacatggtagccattggatgatttcgttgcctcagtccttgaagtagtctatttaagctggggtatcccaacggtccagccaagcagggagcaactcgctgagtatttattatcttgcgaggtcatcacatcggatatcaactttctcctagcattcaaattacggaaaattgcggctacggatcggaagttgtttccgtcgaaacctagcccatgaatcagggcactcaatcgtcggtgtttcactcactcactaagcaactacatggctctctgtactcacgcacgagacttcgattaaactacttcatacctagcacccgcttgagtgcagagcgcaacacctccgtggggttctctggacgatcatgcgaccgcagagcaatgtgtcggtcaggccgaaccagaagagcccctctgtcactaatctctcgtctctgcctccactcgcacaacacatcgtcatatggacatcgtaaccctacgtagtgcaccgggagcttcacaccaaggtcccgactgacctcctcagcagcgacttcccaagactttccaccaatacctacgatgagtccgaaatgtccgtgctcgaaaatatccagaaccgagatccgctgttgattatattcgatccacgcgtgggggacgtaagcgccagggtgagttgtaggctcgtagtagaggactgggtcacgttgatacgctggaaacggcgttccgtcgtacacgatcgcacccgaattctggtagcgttgaccgagctgaaccccgagcgcgttggaacgacgatttcctagctgaacctgctcctccaggtacaaacgacgctcatcggctccttcagcgtctgagaagagattctctagctgcgcaaagccaagctcgcgcgactggccgcgctggaaacctagagccttggggagggcggccatctggtgcaaggtctcaatggcgtggtccacaacttgcttcccaacgggttgtctctcctggctgtatgtatccagcaggctgtcgccagctttccctttgagaaccaaggccagcttccaggcaagattataggcatcctgcacgcaagtgttgctgcccaggccactggacggagggtgacgatgcgcagcatcaccggccaaaaatatgcgtccatggcgatattcagtcgccacaacgtgattgacctgccattttgctttatgcttcactcgtataggtaaagagtctggcaagccaagcacattacgcgcatgggtaatgatggcctcgtccgacgtatcaggctcaccatcctcggcgttgtactgcctattcagaacccattccgtccaaggcttcatgaccacgcaggtgccggatcccacccagaactcatcacctggctgcagcatccagtagatgcaagcaggccgatgagccacatactgggtcagatccatttccacccacgagctggtcatggacatcaggccgggctcgccctcaaagccgaacccggacttggtcgcaaccgttgatcgcgctccatctgcgccaaccagatatttcgcgcgaaccacgtattcaccttggctcgtccgctccctgactcttgcagtaacctctgtagatgactgctcgacatcgaccagctcatggtagaacctgatatttgcacctttctcccgagctctcgcgagcagcactggctcgagcatgtactgtgagatgttatgcatggagcacggacttgacttggcgaaatccgtaagctggttgtcaccgccgccatagcaactgtatctcataatctcctggccagtgaggcttgtggccatgacaagactacctacgccgactagggagaagccggctgcttttgcctcggcctcgatacccatgtctcggaaaacctccattgtcctttggttcgtgacatgggcacgtggggatggtgccgtcccgttgtgtttggcaactactgagacacggatgccctgctcggctaggaggatggccgtggataggccagcgacgccagcgccgaccacgagcacgtcggtgtcgtactcttgcatttcgaaccttgtagatataggggctctagtaaatgaatcagcaatgatatttggaatgctagagggcaaatgtctttacctgctaatttagttttgcaagtggtatggatcaaggtcaatctcaatcaccgcttagtggaagcggaagcagaagatctcctttatcagaacaaccggtctttggaaggcgatgctctacgtgcggaacaacaagattacatcggacagttcgagtttggctccgacctcaatgactcagatggtctgatccaaacgcccacagaaatcaacggagatcgctgggtttacctacacggaatcaatgccggagaagattccggatacaccgagcaccaacatggaggtgcgggtctcaggtaaccacatggattgcaacatactatactcactcgcttgcttggaacggataatttcttggcacacgccataactactctattctcgtcagcggccgtaagtgacatcgtcagtggccgcaacgacagctgctacgttgttgacctctgatgcgtgttcagtagctcattagggcgctgctcttattgagaatgtttcacgggtgttgtcttatagaaggagcattttcacatgtaatttgcgctttccatctgcgaaaattgaaataaaagtgttcagttcgatcaatcactgcgagcagtggcttgattatattaagaatcgggggatcagctatggtgcacaattcatcttatattcctaagtgattgctagcaatcccaatttgattatgttcgggcaatccaaaacaaggtgtagagtatcaaagctcagacatctagtacttgcttcaagagcgccttgccatagtcattcccgttcggggtccttaccagagtgtgaatatgaaaaggcaagggaaccttgttgttcagaaagactccgctgtgatgatcaaactcaatcatgacaactggagaatggaccttgtagtaaaatgcatcacctatacggcatcccccaatccagcagaaatacgtgtcctcccaatgtcttgagatctcctccatcttggctgatagtaccttttccgggaggtagttgaggcaaagaacaaggatctgtcgcactagatcttgctgggctgccggaaatgttgttactttgacgccctcgtatggaatcaccctgttgtcctggaaagctcccccaagatgtcgctgatccgcacggtgaaatcgccactctgggtactctgggccgctcaaatcattgaagatacgcacgccctctatgttctccgagtcgataaactgcatcagactcatgcccactcgttcttggtcggtgaacagctcggtgccgttcttgggtccttcatcgatgacattaggttcagcacccatgaacactggcgaaacgaccatttgagaccctacgcagaagacgttcaaatcgagatggtgaccaaacaattgccatccccaaggctcatcaagcgatggtgcaccaaaaagaacaaagttgtaagagttcctgtttagcacacctttgccgttgacgacgtctccaaggaattcgttgacatccatacagccagacgcctttgcatagccagctggcgataggctttctctcatcaaaccatggacagcagcgacgagctcctctgaaacttcctccagtcggatgccatgtctgaagacgtaaatctcggggtttgcccattttcgccactcgggtgcgtcaacagccctgcacaaccgttctgtttcttctacggtggcagtctggagtatccgctccgccgcggtcaccatggcggccatgggagctccgtggtcctcggagccatcggctagcctatacagacccgatatgacgtttccgtcggtggtgatgcccttgtatagttcgtcgcacagctcgtcccatttgcgcttccagttgatcatgaagggctcggcgcaacggattctggcccactcgtaggtgtcgcatcgggcgagatcgacgcttctttggacatcctggggaggaatgtactgtcgaaaggcagccatttccttcttctcggtcatgtcgtggttggagcctgacggcgcttgctgtgcctgggatcttttgacgacgttcaaagacctcttgtcaagaagatgcgaaaattcaaagggttattgaagaacatttagcccgctactgctacaaaagtgcagagacctagcatcttcaatcaaactctacgagtcaagatgcattataaaatgcataatatggataagctgttcttttagtaatcatgatagggttaccgagagaatagccttgggtgaggtgccgttcggagtccattccgggcagttcctttggcctccgcaactgtcggaccccttccatacaggtactacttaggtataattcaagcatgactttttttagctgcaagtaattaatgaactagtctgcatttacccacggaacaaaaaaagaaaaatcacccattgccaattgcgaaagttcaaccgtggctgtttgctgtccacgggcttcacaggcgactgaggtttcaacgcgaagacgttcagtgcatccatgtatctcaaaattcttacatccagggcttttgctaaaatatctctcatcataatcggaaccaatttatgaataagatgcccctccgtgtgatgaacatacactctctggctgtagggtaggctgagggtgagtatctttgtttattgatggccatactagggagagagggatgatagagttgtcactcataagccacctattgaattggaaagtaaggttagtcctgcagtagtatgtataaactgacagatttattagtagctggttaagagagtgttctggcaaggtgaaatgaatacgtatagcctatgaccagcgtgtaacaaaagttcttggttgttaatatgagaaaatttatgattaatttaatctttgaaattatagatacttttaatttctatgtctagtaatcttatagtaattacaataatatctataaaaattttttatttatttaaactttatttgataagctctagagatttaagaatatagagtagtgaatgaaaggcgtagcggtgtcgctggcagagccctctcgacccaggcaagactgtcagcccgggagaccatacccgagaaaatgtgcagaacaaaacaagagaaaatcccagaaggaggaacaactcgcggcagatcgttgacgcaggagcggaagttgaaatgaatgccaacgacgttagtaaccaagcttgaagcctccccagttgagcgtcgtgaaagtgaaaccaggatcatataggtccctaatcttgcgcatcttctgaatgttacggtctccatagctcgagattgaatcttgccattcaccagaatcacccatgtagaggaaatcagaagccaagcccttctgcttgttcatctcgtgcaagcgtttgagatggtgctgatgccaagctgtaactcgaaggtcgtcttcttcgttcgcccatgaggttgtgaactgccaccctgtaatttgcatcagcttaaatgaccagattcgaggttttgaaaggatcagtcttacagatatatgattgcttatcatcaagaccgaaagtattcccaactccattgcgcttggctactgcggcgccggacttgggcgcgaagttaagaatgaacgttggccgaatccctggaatctccgcaacttcgtccagcgaagctatccactggtcgtagatgtagataagttggtcggcatcgggcttgatcgtgtgatggccgaattgtactctagaaatttgatcaggaacgaacagatcgtagagaccaactggaaaaagccttgtgggccaagcctacctgaacatttgattgggggtctccatttgagagtgccaatcaaccggtcgcatgacagcattcctgcggctcacagctgggagagagctaaatgcgttaaaacgaggcggtggggatgtcgttgattcctcgaggccgaatacctgaggggtggccttcttcgtagtcacgttatagttgatgttgaccacggcaccagcaccgacggccccgtcttccgaaagaaccatggagcaggctgctcggataaagtcgtgggcttgtgaatcgtcaaagatctgataggtgctgctgacttgcgggatgtgatatgttttgaagacaaacttggtgacaataccgaaattgctgccgccacccttcaaggcccagaatagaccagagttagatgtctcattagccaccacctgcgttccgttacccaagaccacatcgtagctcaggacgttgtccatagtgaagccgtacttgttcaagaagtaaccgacaccaccgatcaagctcaggccaggtactccaatggtcttgagcctgccaccaatggtgtagtgcccagacggagcgagagcctcatagacatcaacccatttgttcccaggaccaacttcgatgcgactttggtttgtgtggactttgatgtcagtgagaccattcagaccaatgagtactccgccgtcgacactatttgagccagggtactggggaaaaagttagttcaaacaaccaaaggttcgatgtttcacaatatcaagctcacattcatatgcccacctccgcggacagcgaactgagctttctccttgtgaaatatggcgactccttcagccaccgcatctgccgtctctggaagaaagatacaggcggggttcatgttcgacctcttgtcccagaagttgattctttcctcctcgtatgccgtcgagttgggcatcaggagagcatcaggatatgccgattgcaactgatcacaggcatttttgacactgtccctaatctcgaaaccaagcacggaaagaggcgaaagtgtagcacttgctaagatagcaatgcttgctgagcctgaatggaacctcatacttaaggaagaggaaaagatgaagacgattggcagtaaatgtatgttttgacctgccttgggatcaggtcttttgacatgcagacgctctgtgatatatagttatctgaaacacagtcattagacgcgtaattcgaggataatcgagcccccgtgccccatgagtcgtacgtacggtagttctgccgtgtacgtaagttgaggccgcagccttgccgcattgccgcattgccgtgggcttggcaaactaaacttttcctgcaaatcgcagcataataatgacatcgttggggtccttgatctcaacccctttcacacatgcaagatgagatgggtcccaccaggcaccttcatgtaccgaatgtgccggcaactgctagcctcgtgccggagaaccaaatgagactctgaaggtgagctctccacttggcaagccatgtaaccgtagtacgtttatgcggtgcccattcctggccgtcggtttcggtcccgtttggccagtgacattactttgactggaaagtaatgatgtgcggaagccaaacttgactgactgccgatccttactgccgatctctccaaaatgccgggggtgtggatgcatctcggtaccggtatcgccttcggtttcggcccctgttaaccttgacttaagttgttctattatgatacgtcgtgaagctatgacaatacatggggccaatttcccacatcattgaggcatgtttttatgcataaactgtgatccacaatggcatgcttatctttcgaattatattgcttccccggtataaggcttaagagaatgagctggtcgccgactgcaacgatatcggtgatttgagaaagctttggcagtacgagaaaatcattcgaattccggtagaatacgggagagaatttgagtataatgttaagaacagcaatgaaatatgccagacccgagatctcaacacaatgagcaggtaggataaaactacgacccggcacgtttcctgtccacaggctccgggcaaagatatactgtctctcatccgccatatgtgatacacagtggaagaataaatgaacacgtgtttctcaaccctgaaagtttgaagactacagtaacattcatacgccattacgaaacccggttgagttgcgcattcggttctggatcatgccaccattagtttgtttctctgaaacgaccaagctttggagacctttcgatatccggaaggcgcggtacagcgtagtcataattgccgtgattctccaattatccggtttcatgggtatgaagtatggacacttcttggcacaatgagaaactaatccaagtgtatctgctggctgaccgctcagtcttgaaagtatataaacaagaaggcattcttgcgaggtgaaggacccctcatgaccatcagatgatataacagtcttaagaactctcacttatcgtttacttcttggagtccaaatgtctcttcaagcctccgttctaggcctcgctgccttgttgaccgttgtgtcatccgctgccgtcgacgatggttgcaatgcgttggcctccagccaccccgataagaccttcttccctggctcggagcgatacaggtttgagaatgaatgtaagtttaacctgccgcgagcacgatccaaacataagctcatagaatgggtgtatagactcctggacctcaacgacctacctcggcccatcttgtattttcgctccgcaaggcgcggaagatgtgcagttcgcgcttcaaacattccgagagcgccaagtacaatttgcaattcgctgcggaggtgctatgccaatcgacaacgccgccaacattgggccagaggggatcatgatggctatgacgaatctcaccagcatggctatctcaaatgataccgagactgtcacgatcggggccggtgtgacgtggccgccattgtacgcgtacttggatgaattcggcgtcacggccaacggcattcgctcgggcaatggcggagtcgtcggcgccatactaggaggggggcccttcgggttcatggcctatgaatacggaatgtcgaacgctgcgagatctcttgaggtaagtaatttgactttgcctaccatgtatgaaacctgacatgctaatatacactccctacaaacgtagtgcgtcttggctgatggaacgctggtgacggcgagcgctaaggagcatccagacctgttctgggctctcgttggaggcggcaacaactactgcattgtcactaaggctgttctcaatactattccaatctcttctgccctgatcgggacagtctcttgggggtctggtgtgtcagagcagtatatcaagagtgtggagcagtttgcacttcacggtgcagaacatcccaaggcgtccttcgagggccagacccgctgggtgccgtcccgcagccctgatatctctttcgacggatacctttggtatagcggtgaaggcgacgtacctgtcgggctggagaacttcactgcacccatcttacccatcacacgaggaaacatcacgcgaacgacaataggccaatggtctaacgagttcaactatgctcctcctttcggaacaagagctatattccactggttgactagcgatgccaatgctacggctgctaggatcgccttcgacacctactacgaaagcatcgcatctttggccgacgtccaaggtttctcaaccgctttcagcatgctcccaatcacacccattgtgactgcggcgccgcgtggaaacgccatgagcctcggcaaagatgacagcccggcgatctggtacgtcgagagtcctctgtggtcgaaccccgaagatgacgagcgcgtgctccggatacacgccgaggcgaacgagaagatccgggcgaaactttctgccgctggactggggccgcttccattcatgtacctcagtgacatacagaaatctcagatccccgagaccttcccggcgtatggagcaaggaacctgcgtaagatgaaagccgtcagggacaagtatgatcctgaccgtgtcttcactgaacttgtgccaggaggcgccaaggttgccttggcttagctgagtggatgaagtcaggtcggggggtagggctgatatatcatatggcatcggacatgtacaccattgtgagtatatataacggtgcatatgaatcatagctttgagcgaagctccttctcgtgttcctaactttgtcctgccatcccccattgtctttctttttcttatgtgagtcaagctagctactcaaactctcacaatcgtattctcctatactcaagctttctaataatcttcatgagaggcctaaattatcagtctacaaccttagaactcatagactgctgctgaacaatgtgtccaatcatagcccacatcgaacccaaggctgcattttaattgcctacccatgttcagaacttcatacacattcttaacgctcgcttgaggggcgaggcatatctcactcacgcccttctttttggtagtcgagatatgcacgcccgacaaatttgcgcccctcattatccccctggatccattcttcggcagaaaacaattcaaacatgcccaccttgctcaaaagaggtatagctgctttcatcgcaggctcaagctgcgccattgacgtcgtatcttgtgtcgcgtgagcttggttgtatcccttgatattaactaaaagcgccctgttcaacattacatcttagcaagcggttgatctaaacgttttcttgagctccttagttacccgacggttcccgtttgaaccttgctgccatcgggcaaggtaatctcgggcatagccacgcccagagtggccgagttgatgttctgaaggctagacatgaccaatacgaatatgagtagttggatacaaaactagaaatttctcttttgcagggagactatgcgtgttatttataatctgtcagtctccgtttcggatgttccaacgtcagcacggctacgtcggcactctagtgcatccaacacccggcagtagtgccaaccaaccagccatttctcgctatgatgaaaggatcttctccttttggtattcgaaccccacatagatgcatatcatcatggactctgctaagtacaatacatccttccgttgtttccagccttcccaaatatttagttgtgtgctcaatgctctatagctgtgagcgccatgtgtagaatttaaatagttagcccattagctgacagttctgaatcacctctttgatgtcctagacccgaagtacgtaaaagactgacccaaaaatttcgtaaattttattttgctcataacctatacatcaagtattctagttgtctatcatgtcatagttatagcaatcctggttctaccaatgctcgtcttagttggtgcccaaatgcccataatattggtaataacaataaggttctcccactggaaatctccgccttcaatagtaagagaccccgaaactaacatcccccctaagaattgctcacgaaatgtcggctaattcaaaattgatgtgttttctcatccccagatagggagagtgccctgctctttcacataccgattctaggtccagttcatccctcctgtttttttttctttctgttttaggcaattcctcatctgcaggttcgttcaacggcttctcagcaaactctgggtgtactagaagtgaactgtaaagctctcggatagaaatcacacagtattctggagtctaactgccccgtcctcttggccgtttgtcgaacccaatacacttcacgcttagactttatcgatttcgaggagttgcgtcgtcaacgcccgagagacaaggcccctatctccgacgcagtattaagacaagtgctccgataatggcccctgctatcaaatcatctatatagcataagttggagcccttagggtgggaggaattaagaaggaaacaaacggctactagacttctggcaaatattgcggagcctctcctttcctttgccaacacatcaggactggatacgggtctgcattctaatgccacaacattcaagtataataatcgtaacaggcattgcatcggaatgttccccattgtgaaaccagaacgggctgtactgctgcacagctcttggactggaacttaattggtggaattgggatcagaggtattggcgtcgggctgcctcatcaggagcaatcggatgagcaccctttgtgactaaggtagctccttcccccgatttcgaagttattgtatgctcaaagaatccgaccagtcaggtatgaggaaggaaatagacgaatggattcgctttcttggtgaacataatgttttagttctcctgtttcagcacagccccgtacttcttgttgtgttttcctttgtcatttgttcttggactggggtaaagaagcgtctaactcttgagctgatgattcgttcgaaggtttttcggcaatagttggatgctctggaagtgagccgtgaagttcttgggcaggaagaatgctatcttcgtgtagttcgggcatggatgcttgttctggtggcttctgctcagtcgggcccatttcatgatgactggtcgtcgatttctctgatcttcggctacggcgcccgaggaagaaagctcctgcaaggagaagaaggaaagcaattggtccgatcacggcccctgcgatccaagcttctttagattatcagttaagtgagactcatctagcatttgtggggtatcagcagggtaccaactgttcctagggtgctcgtcgggagatgaaggacctgtggtctgttgaaccacattctgggattgggtcgtagtcaaaggataatcgatggtttgcgatgtcgaaattgatgatactgtgacgcctgtcgatgtaggtctggttactgagccagtatcgaaagcaagactgttgtcacctgcggttgatgctattatagggttgaaaggggcactggccgtatccacttgtggtgacatgtccagctttacagatagggtttcaatactgaaacgttgcgaatggtagactctgatctgagtattgagggtggggatggggagaggagaggagggagctgtttaacggagagggcgactttccgcaggttatgtcttggaggcccaggaggagtcatacacaggtattcagtgaacagtgcatgtgtgctcagtacgtacccttacggtacttctgaaagaggcgtagaggagggattttgaagttgggtgtgccaaatgcttccctactggcctataaaaaaaggcctgatgtaaaggacaggtgtggcgtagacgatgaagtaatccctctcctactatgagcaggaagatacttgctgcgggttccaaaagatcattgagacctgagacactgtacgcctctttttcaaatttatccaatggaaaactaaacgcatggttcaatttatgcacggatcaagattattagtgagaccatccatcagcttgcaaaagtactgttgctgttgttggctgcacgcacaggacgggctgaagcccaaagccccacttccaaaattgatttgatagagtacagccacctaatcttaaggctaaaagagaccttatttgatatggcggacagtctccctggttctaaggctatactaactcctgaatcagcgataaagcacacctgacagtctctgagcatctgctatacagtgaaagtaaagaagcccaggcctagatattgggaatacaaaattcgaaaggcgttgaaagccaaagatataatcactacctagtagctaagttaatgttctctctagtgtctcattaccacttatatataggtctagcttgtattctcagcgatcagaggattgacatccgtctccttgaggatatagctatacatttcctcataaggaacgtcgcacgtaggagtaactcgtgttccaaagcgctcacctttcgggtactccaaggacaccgtttcgagcttccggaaaccccgtagcacctccacagcttcagaccaacggccactcagaagccaaccatagtcccacttaaaagttgtgatagtatctgcctgtagagcaacaagcgccctcaaatcctcgattgtggcgggctggtatgagagaatcagagtatccaggtgttgccaagggctctccaagggtaggagatcagataagctgacctcgggggtttgatagcgggacgtataattgacgaaatcgatttttaatgtttccagatcaggagccgtaaagaagggcttggtgaaagagcaaaggccgagcatgccattcctgggcggttcactactctcccacccgtccacgtccagcctggcatgggtgactttggacatgagaagtttgaggccggcctgttgatcccttgacaaggtgatgcgccacagaaccgcgggtgcggtcattcccacccatactaatcgaggtctggtcccgctctggccaagacgggcgcagagctctcccagcatctcaactggagggacaatggtagagtttgtggtatgcgagccgcaccaccgcgaaggcgagagtatacagtcaaaatgttccaacatcctccgatcaaagccaagatccgggaaatcagaagcttgcaactcctcgtctactatcaggtatgggtcgtcgaagcgaaggttgcagaggtttggaagcttggccagcgcagaacaaatccggtcaatgtggttgttcccgcggcgaaccctctcctgatcctggcatcgttccctgtatctgctgtagagtcgcatggctacctgctgaaacggagtagcttctttctcgtcgaaaccttcttccgatatcttgaggagcacaggattgaagtacatgagttgccaaagttgctgttcaatctctctctggagagcgtcctccctgttcttgtcttggaagctgaatggcggcactctcttgcggcacctgctagcgatcatgcgccgccatttgtaggcccccatgcgttcgcgcatctccatattccgcagtaggcgcccggtgcaatcctgcatgaagagagatcgatccatggccaggctgacatcgtactgggagagaatgatggtgacgtcggtgatggatttggaaaatatgtcatggttgcagagctcctcaagtcgtgataaagatttggaggttacgcggacttgcgcctcgtctataagatacggagcagctgcgttgttgaaggcccgagaaacgaggcgagattgcttgacagactccttgtcgcccatatgagagaatacgcaatcgagcacctccattgggagggattggatgttctgtttgagcgccattttgatgaagatgtgctgagctgttttaacaggcgtgctatattggtgaatggaatatatgaaagaaagagaacgctctgagagaaacgaaccgtgagttgttgataaagctcgcttcttccttgtcagatacaacgtggcttagttgtctcagccccgcttgaaatcatcatcagtagtaataagcgagcagtggggtacgatttatggtgctgacacgaggctcagccatatgcgctggagcaaaaacataattagacgatcgaaaatccaagcggcaagaaaggtgctgtagtggcgaagaaacgggacgtgagagatctaggtggtcttttgagtccctggtgttaaccggtgaacaacttgtgctgtctagttgaattatgctacgttgattcgatgtcctctcatcaggtttgaatatgataccccatatgcgagaagggaggaaaagtagttattatgttgagatgtcgggtccggcccttttccgttgcttttttccacactttatacttgagctctcatcaggatactacgttgattcatcatttgtatatgtcacaagttaatccgagaacacttaatagtaatgtcgagatatttatatggcatttctaatgatacaatctggtaatactcatattaacctcaacaggccatgacaaaggaaatgcggtaacggcaaagtgttagaatgcctcccaaattaacaaacgaaacgaaatactcagaaggggtatcaagtatcaaaacgtattccagcttccatcgctaggcaatcgaaaccagggcaaaagacaaaggagagtaggcaccgaaaagactcgaaagatagaaagcgcgtagcaggcagtcatcagcgccagagaggaaaatcaaagcatggcaagctcaagagtgaacttatcggggcaccgacttgccctccttggcgacggcgtcggtcccggcagccatgcgtccaaactgccactcgggcagggagatgccagtctggtcgtggatggtggtcatcagaggggggagcatctggtagacaccgcgcatggtctcggcaggatcctgctggccgctgccgccagcgccgccgttggcgcccgtgttccagacgctgatcttgggagccatgccgcggatggcatcggcgttggccttggccaggtccacgtaggtgccgttctcgaccataacccacttgagcaggccctcggggccgccaaaggcagtggccatctggccgtaggcctgggcgagggcggcgataccctcggcctccttggcacggcggatgcagtcagcctctgcctgcttctgggcggcgtaggcctcggcctcagccctggcgcggatggcgtaggcttcaccatcggccgccttctggttgccctcggccgcagccttggctgctgcctcgacctcgtacgcggctgcgtcggcggcctgctgcttgctctcacgctcaatggtggcgcggacgacgtccttggcacggagacgctcggtctcagcgatggcacggcggatctcgacatcctttcggaggtcttcgtcctttgcttcgagggcacgcttggcggcggtgcgctcgaggtcgacatcacggttgaaccggacctggtgggtttggaggtgggcctcggcctttgcacgttcgacatcacgctcggtcttctggacggccgtctcggcgtggatcttggcgatctcccggtcctgctcacccttgcgcttggcctctccgacgttaccgcgcagctgggcgtcggctacatcgattcgggcctggttggtggcaccttcgtgggccttgcgggccagcgattcgaagtacacggagttgggagcatccttgagctctttgacctatacatccaatcacgttagaatactaccgcccgggatcagaaagatgggagggtatggaatgggtctcacgttggcgttgtagatcttgagaccgaactggtcgagttcaccctggatgtttcggaaaatgcgtttcttgaaaacctctcgctccgtgaagatctcctccatcgtcatgctggagacgaggacacgggtctcaccctcaatgatgcccttgacgatgttccccacgtgcacctgctgctgggggttcttcgaactggtgtctgaatctgccaggagcatggcatacttcataagtgcgtccccccgatcctcacgacggccagcgccgccctcggatccctcctctgacgcagcctcataatgttgggtgtttgccccccgctggttgacatctggaccgactgtgaagacgacgggcagagagaattgaagcttctccttggtcatggcctgcaggtccatggcatagtcatgcggttgcacgctgggaatgggcgttagacgatgtggcacatggtgagcatgcaaagtgtggtgacgtacctgaagcgcatgcatctctggaagggccaaatccatgctgctttggtgatcttgacggtctcgacgcccatgccagtgatggcaaggtactcatcgggggccgagattctgtaggacatggtggcggttgttgagctaagctagatggttggtagtgactgactggaaggaaggtgaactgtatctgatgacgatcacaagtgtgagatgatttcttggtattcgatattatgaagtttgatgggaagagatcgtgtagaagggcgggtggcagcctgtctttaaataaacaatcatgcaggctgcaggtttcgaatcagaggctgcctgccaagagaaaacactcaaggcacaaacaatcccaagccaccctcctagtttaggctctgccctatgatgtgcatatggagtatggggcagggcgtcctgaacaaaccttggggctatcatgtgatggcctgccgcttatccgcgccgcacgataaggaactttaggtgaagcaaatatgttcttcaataggtactcgccgcaaaagcgatgattgatccttgttagcagacattcatggtgtgtgtaatggaacatactagagcgaggctgtgctgtgtaatggtacagtggtaattcaagcagccattgatggccagcacagggggcaaactcgaaggccctgtaggctgaccctgccttctggaaatcttctagccctccctccagtgcctgtgcctcgctggagccaagcgctaggcgtacatcctttccctgtgcatggtggcggactcgcttgtgatttagcgtgcttgggggcctggaggaggcacacaaaccgggcgagacgctgtgggtcccggttccgggcatagttacgggcctatggtgagtgagtaatcgctcgccagaggcagcagcaagtggcctggtttgatgaatggatggtagcatccgacggacacgggtggccccttcgcttagtctgtacgcgctggcaagaccaagcgaggaatgcgcggatacatgagtggtttcatttgctggttccagttacctgcagaggatatgttcagccgcaccgcaatggcagcaaagggggctgtgtacgtgtagtgtctgttcaccgtagcttcacctttctcagtgcagcaccaacggggctccaggacccttgatctacaagggagcggcgataatcagtgcctcaatcacccgatccccttgtttccggatcgccctcattgggtctgcgcccggatatgtagcatcacggccggccgagtcgcattgtcggtgcccaaccgctgtgagtcctgggcgtaaggcacgctggcagtggggcgtagggacagctgacaggggacgtgggctctaaagcgcgacgctgggccttggccggggcggtcttcaatgtcacatggccgcctggaaattagttctctcaccatccagcctcgtgcatgccttggctgctgtcaacatcctaggcacacgtcacattaaacttcccatctccggtcgcgccaaatcacggagtcgcgtccagaagataagcgcgaggcttctttatcctagcctcgatctcgtgtctgaggctgcctactacttactcggtccgcaagggattgctgcatgtctcgaactgccccgcctcaaaccttccagccatcccgccaaaacacgcatttccccaacttctggtaaatcacttccccataacgcctctttgaaccacctgcatcatggacaaataccatctgtcgagacatctccctgatgacgatgatctccctccaccatactcgccctccgcctctgataacctcggtgctaagtccgaccgcaaggactatgactacaaatcccccgccagggaactcggcaccgacggccagatcctcaccgagatcctcgacaatgtgaggtcactgctctcctcggtcgaaaagatgtcacctccgccgattctgctcgagtccacctttgtgcctgccgcggcgctcgggcctgaatgggtccccagcgacccaggcgagaagtcgaggcgggaggtcaagaggctgttcagaatcggcgagcagatagactacagcgacaagaagaagagctcatcatatggcaacgactcccggagtgactacacatcgtattctgaccgatcgagaggcaagggttcgggattcgcagactggggaagattcgacgatgaccccaccgacgatgatgcgggaggctccgcgctctggtggtcggacgaatacatggcagagcgtctcgcaaacgagctgcagcctccagtcgcaaatcctgcaaagtctgcctcgagccggccgcctcggccaaaggacagcactaacatggttcgtgcatttctgcagagcttctccgatccttcgcgagtctggccgccgcgccatccaccgtcggccggatctacctcgcgggccgttccaatagatgaaggcattcctataatgacggcgcgggctgaggagactacgtttcgacgggagaacgagatgggactatgggagagcaagacgggctgggctatagttgtgcgtattcggtctcgattttagtagcggtgttgtatatataacgagtctttatatcttggtaatttttaagtcaatgtgcaattctttgatatgatatttgcttaatttaatcatatgttgcataactagatcatcaggtgtggttttacatgagaagatgatcttcctttaaggggtagatagttggcgatatcacttctcaaaatatgaaccattataggaagcttgatttcaaactgaactcttccttctctcacggctaatgaaaaagcttttagcaggctgtacaacgaaatcagagtggaatcttgtatgggcgtaatacgttttgcacattgtgtctttaggtatagggtacgctcttccttagtaaaccaacatagtgcggtgttgcctgctagcttaaccttatttcttcaatgaaattctcgacaagctgtcgtatacgatggctgctttgccgcttgtgatcatgctttctccttagcattccgagcgcctttcccaccgtgaatgtgaaaaaaactatgagcaaacgtaggtggctttacttttgtgactttgggagggctgtattgagccgagccgacgtcttttcaccaccgaagatgcttcccgtcgctttggatcagggatgcttggatgatgcatcggtggtgaagcatgcccttgcctgcaccccggcgatgcagcagcgccactggtcgggcggtcttggttggtgcccgaccgcagtagggatacgctgacagccccgtgcctgaaggcgatctcttggcgcggaattcattaaaactcgccttggctggcgattaagagatgaggtggtacgatccaagcgggcagtgcaatgtcggcccttgcagtcatggagcggacttcgggtcggatggtgggtcggccgagtctgatctgatacggacggtcggaatccgggcccatttccggccggatgagcttcctggatggcattttacaacaaaccagaaagcccatttgagcaaatttatgacgatagaccgacaagtcatccagcaaggcagacttgaatctgctaattagcaatattgaattaaaacgtgcaagtgtcatgcggtatttctccacggccgaaaccagcccgcgacccttgcacacacagccccgaagtggggagcactgagaattgtgatgggcagctcgggcaagtcggggtgcttgaatacctggttgaagatgagggagcgcatttctcatcaacggggtggatgtcccatgccccattggacacttgcatggtgaacgaagcatattgtatctagccgcgtctgcatattttgtagcactactgaaggacttttcaacttctaggacaagagcgcttcaaatgtacttgtaggtaattcatcaataattaatactgaggtcttcttcgacctcgagaccgacttctctcgtttgtcctgctgtggctatctgctaaacgccctctatcagtctctctctcccgatatctagtcctccccccagtcgggtttctccctggcggcttctctgcgttattaacggctcttaaaaggtgttccgacccagaagacccggcctctattggggtctcacccctatcatcttttaaattatcatcggcacccgcattcctcagtaaggtgacaacatcatcatagccgtagagacaggcccaaaacagtggagttcttcctctgtagtcctgcacatcaatttccacctccttccgccacagaaggacatttacaacatcgaaaaatccccgaaaggcagccaggcacaaaggcgtcatgccgcttttgaagtccctaacgtttggtagcgtatcgtcttggagtaggtcccttactctccacgggtgtctgttgatgacttcatgcctgagttttcccacattgtaccattgtttctttggttggaagaacccgtcatcgccgcaaaggaggtcgagggcacggcggttgttcacagaggccgccaccaaacatacttcttccgtgatggcagcctccacgtcggcccgcctgttctggataagaagctctagcaaggaaaggtctcctgcaggccgagtaaactctctggttttgtggttgtattcctcgcccactaccgtgtgctctgctgccgcaacctgaagcaatctgtcggtgaccttgaacctagttccaaacacatgaagtagggatgccgcggacttaggcttccccaaccaagccacatcttccacgacttcctcgctgagcaacaaatccgatccatgattttcaaataacagagacaccatagcgtcagcgtgctcatcatttgaaaaagcggatatgattaacttatcagtgatcttaatttcaccgtgcctgatttccagcagcaacgtcatcatttccgtagttcctgcagatgctactcgctccgctagtctttccgatatttctaacttccagtgtggttctcctagaagcaaccgcgcgatctcaatggtccttttattcagtaccgcactctctagtactgcacctgtaattacgatatcgttggcttgtgtcttaaccagaacctcgagaggtttattatccccaagttgggctaaggattggagaaagtcctcggaccaaacaatcccacggccgaacttgttgagaaagcacctgaaaactgatacgccattcaacgccatctccgttatgattgcatctgatatttcaatatctggacggcttcggttaattagccgtatcatggtctcctccgcaggctgtatcttggccgatgcgatctgaagcatggtatcgggggtgtcgcaatcttcccgctcgtctaaaaatgagcgtatcataacccagtctctgagcttgaccatttgctcgatggccttctcagtaaacgtcgcgttgccactctgcgcaaaaatatcgacaagttcccttcggttggaccgatcatcgagaatcacagtcaggacgtcgccggtaatgtggatcttccgacctgattcgatgagtgagcgaataatggctaccccgtgctgccgatttcgtgcggctgcgattagcaagtcctcactaatttctactcttgagtcctgtctctccagaaggagattgaccatgtcggagtcgaaatatcgagcgactgaaactatagcctcatctgtgaatcgcgcacgctggctttgtattagtgtgacgatagttctgtagcccgccattccattatctgccgcagcggaaactttttctggactgataatggtgccgctggtttcgaaatccgcaagccaggttatgtttgcttgagtggcgacatcccagcgagtggtagcgttgtggatgtcatagaggcctgcagaagcaccccaagtgagtagggcagacgaccgaggttccgtgatacgaagaatcagacttgccatgttgtgcatgccatctaagtcattaccgatgtgtcggtgccagttttgtgaagcatatcgtaaaagaaaggtatttggaaagtcagtcccattgtgggagccgaaatcatcaaagctcaagtaaatcaaacacgccttggctaggtacaagtttggtttcaaattccagcaaaaggcagcaggactcaaaatgtcgctggtaacaaggaagtctcgcgctgactggtggatcaaatagagtctgtcatcgagatcacggatatcgatgatgattccgacggcgcgggagacgttatgctttgtgagtctggcacgaccggatctaatggagtcaatggagtcagaatcctcctgaatagaaagcgcgtcctcgagttccgagagtgctagcggccgacgaccgtagacaacccatagaaggagcttcttttggctctcaccgcttctggctaagatgtctgaaacaataccttgatatagatttccgaggtcggaaggacttgctttgatgattcgctcaatgtctgccaaggatagcagagcttcggccttgagccttttgacaatcaacgatatccataaaaatgtctgctcagcgcgagtcaaaaggagtgcaacagcgtctttgtgtaactggggatcaaggtcgagtgtttctatctcgtgattgacgaacacttgtaaatcctgagggttggcgactagatggaaactgggagatcgtgacagctgctgctcaatatcaacggtggggcggctcgtgaagattgttctgacagccggtgagttattcttggctcgatttggctgggatagcctactgaatagtcgaataagacgaagccttgatgctgcattttgacattcgtctagtccgtcaatgacacagagtacctcttgaagaacaggagctttcaacaaatgttcaaggatctcccacagcccgtcctcagccatgtcagccgtgttgtctaactcgactagttctgcgatggccccaaacgtgtcgacatcacgcacattgagaagctgtctgatgagcgatcttacggcatagccaactgtagaaagtacatcactttggccgtaaaagaagtagaaaatgactttagtttctgggcttgcgctggactccttctccatgtggcttaaaagaaacttggagagtgtcgtcttgccttgaccagctgaccctttgatccaaagaactgatggctcttcagaatttctccaattcgagaaagagtcttggtccagaatccaggtcagagttcctggggtgggatcgtcgaccatgtcgttccgaaatgcaccgtagttaggaacgttgagagattgggtgaactgtgtctctaaccgagatagctctgcgttatgatactaattaggtcccttcaatactggcatggtcggtttagtgatcttactccggcgatactcagcgaaccgcgccttcacaataatcggtcccttttctaccagttgggtgatccttgatgcgataatagtatagtccgggttcgactgatcttcaaacttaaccatgtcggaatggtctgcatcgattgatatttgatcatatgtcatctcgcttggcccggcatgggtggcagacgcctgttccaccatcataattgctggcccagccctgtcccatgagcctgtttcggaagaccacttgaatgaatcaatcagcatgttgcttaatttgaagctggtagagactacttacctgaactgctcgcgtagccttagtttcatatacgctaatgatggttgagtcttcgagcgtgaaggttttgttaaatagccgatggagaaggcttagaaatcgagaggacccggataaatccctcacgagcgactcattaggttgcccgcgaaccattgccattaggctagagttttcaaggccccgatttgggacaccgaaaaacatcagaccgaagcaagaccggaatacggttttatcttcgtcgctaccctcaaaagcctcgaccaatgcctaaaagaagggaaatgtcaactaggttaagaatttgttttcacgcaggatgggagttcctgacctgtttgacaactagccctccaagactatgtccgataaatatcaaaggcctggtccgcttctgggcattagttgtggtatatgagtagggatattcattaggtccacgtaccgccttttctccacgagtagtcttgatggattcgagcaatcttctggctaaatcggtgattgaagcttccgactggctgccggggagttttgtgtcatatccgtatgtcaagatacgtgctcttgggatagaatcaggaaggaaatctcgcagccacatggccggctgccctctggccttccatgatccgaacgcgtgtccggacagaccggtaacggcaatgatactttagaattacgtataagttggccacaagttcttaagaaaaaaagaagaggacatgaaagaagtgaaacctgttgcagatagcttactcgacacttggattctccggtggggagtagattggtgtgatgccaaaaaagtcgctatcagtcctaagccgatctgcttcgatgccgaattcgcccttcagggtgctctccaaaatggcaacgtccgggctaacaacgaaagtaacgcatgccacgcgaaatcgatccgtgagtccaaacgctgcagcgggctcgaacgagaaagcagagatattggaagggtagctcccttgattccccgacagcttgttcagagcttcacggaacttgactttggtcactgattgagggatattagagattcgaaaagtctggaacttcttcgggctggccaagatgcgctttggtttcgacttgggttgcaatttcggcaggttcatcaaccgcgcgccaaatgcccagaggagcagtagctgagcaacgacaaaggtcagaagccctataaaccatgttgaagatgacatgatcatcttccgccacagaccatccaaaggctcccgggtgcgagtcgaaaagtctagcctttgggggcgtgatttaatgactatcgaagagtgattgaatggtcaaatcccgcatgagcttcgtaatttttcccaataagcaccagactgcaaaggtcaaaccccgcatgagaggcttcgtgtttcttccaataggcatcagactgcaagtgtggacagggattagagtctccacgtgtcgtctgacatcaatctacacataagctgcttattctcgagtctgcgaccagtattgttagattattcagtgctaataatacataattcagggataatactatagcgtgtattttcactttatttcaaatttttttttaactgctgagtttctctgtttattgtagaaagtagtcatttatattcaactcccctaatgggtgtcttatctctcctgtcacccacttacaggcgtagagagaatctctagctaaagcgaacatacaggtactggtcttaccgaatggccatcccaaaatatggagatactcctcccatatcctttcctctcacagtcattagaactttcaccatgacccacgccggccccgggagtgagtgaacatcagtgatactttgtttataatgagtcgttgtgagaggatcacaatgccacttgacacagaacctatataaatatgtatatatatatttacgcagtaagatcgggccaatacgaatatctaaggtactttctctttgagttgcgccataatctctgctagaaagggccaagggtccaatgcgataggatcaagataaaggaggtccaagaaagctactcccaagtacctagaaaatctggtcttctaatttgcatcaggttcgctggtcatagtttcgatgattatgaaactctctggtctttgttgaccagaggcttagaacttcttgatgcttactgactacttttgaacaaggagcttggttgatacgggtagtcggggccacggatagaccatcggataacagaatagcaccacctgcactatagcgggcagcagtttttctttttgtcaatacttgcaaatgccccctttgagctctaaccgagattttggtagagttcatttccaattgatacctctcaatacaagttggcgtggatacatgccaggtgctgagtctgaccgttgtctcatatagagaaatcagctataaattaatgcttgctaagagagagctcttcgtaacgcaatgttacgccccacttaattcaatggccgctaacgtcaaacgctacatctgatgttctcaactttgaggttgctgaagctagcatgatcgatcattatggtcttggttcttctacaaagggctgatatttgtcccgctctgctgtgtgggggacatggagttgccttagctgcgagtagaaactgcaattcttccctttgagcgctgtcagaaacggtttcttatattctgatgacttgaaggaaaggagcgtgcgtgtcattatacgctccaccgttgtgctgactgggtgacatctcgtgccgggtttaacaacggcagtgtgataggatttttgatgggtatccggctttgtgaaggatttacatcctgcctctcaggagaaaaggaactaattaaatgaataccgaatgaagggatcgcacgttggcatgaagagaagcccaaagcgtgctagccccctttcgagacatcatcaaatcccgaatagccggacctcccgtcagcactagacgcacttagcaaggttgtttggctcctgcttgtattacaggtttatcttatgaagatgacaaggcccaattcgtgggccactaactttcccattccatcgtccgaaatacaaactcgatgctctatgtccgtggcgcgatggacaagttaaaggtcgccgtcataggggcaggtacgtgccccgagtcccacaaggatgaatgaatgttggcatctaatatttacgaactaggtcctacgggccttgcaatgctcaaaaccctgaaggaagatggattctctgctacgctgtacgagcgtcgcagccaggttggtgggctctgggcgtatacagaaaatatggcgtggacgacggccttgaaatgcaagtttcacagacgaaacgtgcgatttgtgacatggaacttctcgactaaccaaaataacccctttagctacgcaagcgaatatcagcaagtacacgtgcggcttctcggattttccaatgccagatagtgagttttctccttcaataacccaagtccgcgtttattaacaggccgctagaatacccgcatcatatgaacgtgtatgaatttcaggagtacatggaagactacgcccggaatttcgatgggctcaaagactgcgtgttcaacacgtcagtgaaagaaatccgtcgtaatgccgatgatactcgctgggtactggagctcgagcaggacggcaccacctcctctgccgagtacgacaaagtcgccgtatgcaatggataccaaaccaaggccaagatcccgaaatttgaaggacaggagcttttcgaaggcaagatcatacatgcacagcaattcagagagtaaggcccttcaacacatgcacattctccttcaaactaactcccatcgtgaagtcctgagccattcaaagacaaaaatgttgtcgtcgtgggcctatgtagctcttcaggcgatatcattccgactctgatgcctgtagcctcgaaagtctacgtctcacatcgccgtggtgccgtcttcgtccggcgtttcctcaacggcacgcccgcacatctcccccttacttggcgtcgtcgaaatattggcatgtcgctacagaggtatctcccgaacctcatgcgagtttgcggcgacatcggggtcaaatatataagtaggagaatgcttggcggcaagccagacccatcgtgggggatcgagccgttcccatcgcccagcttgacgctgccgggtgtatgggagcgggtactaccatttctgcaggacgggagcttgacatcgttaaaaggggtcaagcgattcacggggccgaagagtattgaatttgccgacgggaccgtggttgacgatgtagatgcggtgattctggccacaggttaccaagcggacttctcgctcctcggacccgacattgttgagcgaagtaaacctgatctagattggtatcacggtcctgagatgtatcggctgtggatgaacttgttccccccaaagtacgccgactcactcgccgtcataaattatagcgccttcggcaaggccaacggattcagctttgccgatgtgacgagcttggcgatctgcaatgcgtggcgagggctcgaacccttcccatctcgtgaggctatgaacaaacacgttgacgagcatcagcgatgggtggccgggcgctggcgcatcgagccgaacactgacacgagcgctgtcaagacctgggagttccagggctggcttcatcaggctgctggcacgggcatggaaagcctgggttggggttggaaaggctggaagttttggtggcaggaccccgagatgtacaggctgatgaacgatggtgttgagacggcgcatatgtaccggtatttcgagacgggcaaacgcaaggcctgggagggtgccagagaggccatcatccatgtcaatgatgtggtgaaaacaaccttccctctcgaggagaagaaataagttactgctggtataaactattattactctaattttttttttcttttttttttccatttatgttctttctatctctctttctttctcaccgtcagattttgttaaaataactagacttatgggattggagaacttggctgagattcagtcccacgaccaaggcttattatagccggcaatgcaggataaagaacccccacaatataatcgcatttccttcgtaatagacccttgtttcgctatttgaggcgcagcagctggtcacgggggtcagcattgtggaaatatgcctgattccccgcccccaggcttatccttgaacgctagatagcgcctcccatcgcagaagttttacgccccttttaactttcgtgaagcatcttatagggtatggatcaagcccgatggaggtactcggtgctgtagcgagcgtcgttactcttctagaggtcggcggaaaggctggcaaatttattaaaggcattcgcaacatcccggagagctttgaggagctaagagaagaggtgagtggtttctctccatgctgactatgggtagggtaagagataacaagacagtattagattggctttcttaaagtaatctctgcggagctatcgaaggttcaagaggctatatctaatggcagtcacagcactcgtttgagatcctcttggcccgctagtatcgagaacatcaggaagactttggaggacacagtacgcgacctagaagacatacagacgaaatgtgagcgacagcggccagatgcggagccggctgccaaacggcgagcatggctaagtcatcgtacccggatctcgacccttctcaggaaagccgaaaatgcaaaggcaaatctgggactggcactgaatgtctttgcgttggcaatcatgaacgctcagaccctaaaagaagatgctgcccccggaagagtccacgagatcgagaatgaggaggaaatcgaaacaccgccggcaatggaagaaaattccacatccgttacagcaacggaaacgcagttaatgaactcgcctcgcacctccgtagttgccaaaatgcgacagatatacgccggtcgttgccgatgtcactaccagaagcagccctggcgcatccgcagtccgacgtgggcctcatcactggttggcggattcgaggtcagagcttggtctggtacggtgtccaactcctctccagcttcaagctgtacatgctcacgaaataagcgcgtgtgcgtggatgatgggcagtctcattattcattggcagctaaattcttcttgggcgggtcgttctatactctagaatttgccatgcgcccagtaaacacaaggcggttaattcatctcattggatcctcttggataggagcaaggatagcttacaaatgagcatgagccagaatggggtgtcatattttcccgatgatgaacaaaaggacgggactactatagtaccggtaagcattggaatcacgtttctatttcataagagtctctgactaaattggcgtcgagcttagatcatcattgagttgaaggcgtatgatgctctggaattgctgctcaatgaatgggagggcgtgctatctcgaactggttttccccggtacgatccattctctaagtggacactattctttcgatgagagactaaccccaaagacaacaggcaagtcggatatgctgtgcgaagtgaacaaatggcgatgatacagtccggggaacaagatgagcgaaaggcgagaatgcttgagaaagtggcttcatatgtgtgggatgaggaaacagaaccagaagccacgcctttccacgaagccgcgattgacggggatgctttggagatgcagctggtgttggacaagctggggagcgcttccatcaagattattaacgagttggataaaacaggatgctcagccctgcaccacgcatcacgccttggtaatcgagaggttgttcaaattctagtgagagcgggcgccaacatcaacatcaaagacggcaaggatgggatgacacctctgatgtttgccgcattgaaagggcaggtcgaatgcatgcgagccctgttggagccaggcggaagtaaacgaaacgacgtcaatcaaagaagcaatctcggttacactgcgatagattgcgccgtgattggcagcgatactactcccgaaggcgtccgcctgctaatcgaacatggagcaacggtttcatcccgtgacctagacggctcaacgattctacatcatctcgcaagcaccccgtgcccggaacaagacgcccaggagatctttcgctctattctcgagctcggcgagctgagcatcgatgtccaagatcctcaaggccattcccctcttctaagggctgtaaaactgaacaacttgccaatgcttcgttgtttgatggaaaatggagcttccacgaccgttcgggacgattactcaaataacttgatgcactatgctgctggaaagtcggatttggagatcttggaatatctcatgacccaggacttgtctgaactcaacatgaagcatactaactactatgatgaaactccgctggactgtttgatcgacgccatcactcagagccatggcagcttggggcactcgagcgacaacccagtacggaggaagtggcagcctttgtacaacttcaccaagccatcgaatgtgcaaacaaggagaaagacatttctctcctgcagcaagcccttgactctctacccatcgagagccccgataccaccacagcttgcgcccacctcgcccagttgagtcagaggaaaaaggagaacccaaacccaggcgattatgcgttctatcgcgctattgagaatgatgtacgagcctggccaagcggcaaagctttgccagatattaggaatgtcatacaagaagacttgaacgagctgagagactcattgagcgagctgaggaactcggtggacgagctcataaactcatttatgaatgtatgaggcataggtatttaacgttgggaaatacctcaaaccgaacggttaacacggtatgtatgatcactctggtgatgagatacttcgacaatatctctcgcagctgcgatatagaatatacaatggcgttatcattagatactacctataatttatcaacatttagtctcaatgaaactaaaaccagaccggcgtaccgtgttgatattgagataaggtatgcaattgttctagccaacgctgacaaatctaaatgtactaatgctaagtccgtgtaagagttactggataatgttttatctccagcttttaaccccgcccgctactgagtaaagttccattcctggtgaatcattacaaatcgaccttttacaaaacccaggccagtcgatgatataacgccaaaggaggtttcttcctcgtttattccgtctcaaaaacccctccacgtgtacaatgtcaagcattgctaagactgttattgcgactggcgtgtcgtcgggattggtaagtttacacatttgcaaggactctggagtcgtggagtcttcaacctcatcacgattgaagcctgacacgttacacaggggtttgaggctatcaagcaacttctccaacaggcgcagccttacagggtgattcttggtgcgaggaacaccgaggccacggaaaatgcttacagctcgctctcgtttgatcgaactaaacattcgttgagcgtgctcccgcttgagctcaacaatctcaaaaatgtcaaatcatttgcgcatcaggctctcggaaagctaggggaggatagcatcgactacttgctgttgaacgccgcaatcagtgaccctgcccagggacccgggccacatgggtcgaagtggtccgaaatcctgattgtcaatcatacttgttggtataccttgcatcagttctgcctgtaatgagctaactgattctctcctcaaagctcagcattatctagttcatttacttcgagaaaagcttgccgcgtccaaggcccgcctggtcttcgtctcgtctggagcagtgcgcaatatccctgatccaagcgtcctagatgaagacctcctggcagggtccggcaaggatagcatgactagctacccacagtccaagttcgttgcacttctcgccgcccattggtggcgaaggcagttggctggccagtgcaatgtcgtggcggtctctccaggcctcattccaactactgggctgcagaggggatccaagctttcatttccagatgctataatgaaggatgccaagtctgttccagagggtaggtccttttgctccgcaacatttcattgagtgtgtttatagctgatcatggcacattaggcgcgaaaagcatcttggaagccttcacccgaaacgacttccccgaagatcctcagcagattttccttactagctggggcgaatggtggccaaaggatgtttatgcgctttcgcttgatgaagcgctccagaacaagtggtgccagagtcaagaggaaattgagacagagatgggaattacggcataattccaaaatacgatggcttttgaacgggtggtacatcatcagtcgtcttgaattaccttaacctaggtaccaaaatgaatatccaacgtgattaaatctcaattctccccgcctaccctattgctagattaaatagttccatcagaacaaaatccacagctcgcccttgttctatccacatcgtacgagccaatatatatcgcggttttattttcagtttcatttaattaattatctgatcttatttcccatctgaatacttccatcagagaaggagacggattaagttataaatctcagacgtaagttgttcaagacaagtgatgacatgttgacgtcaagactcaatgttcagaagacggactttttttcatgccacatcgcagtcttgtcactgcggtggctggcgtttcttggatttggttttggttgatttcgctatctgatggttgcggattaagtctcgcgtcaatctttggttctttgtctccatttaagcacgggagtgataactcttagttctcctagaccaggagggggtgtcgggctatagggtaattgaaacctaacaggcctggaactcaaataatatctcgacctgatttctcctttcgcaatgccgagcacaactcgcgccccggaccaagcacgaagtctaagatggaatcagacatcaacatacagccacaggagcttctttactacaacaaaaggtaccaaataatcatatgcacatcctgccagtacgcgatccagccgactgcccttgaccgacatctgaaggaaattcatgctcttcaccggcatcgtcggcaaccttacacagactatgccgccaggctacctttgaaacagccctcagagctccttggcacaagaccaagtattattctcggtgaggacgaggactttcctgtgcccggattaccagtcatcagcggcctccagtgtctggatcccggctgtggacatctttgcgtgagtgtcaaacggatgcagagccactggaaagcggaacaccacaagtctggttgtgcagcgttagactggcagtcggtgcctctccagactttctttcgagggaatctactgcggtacttcactcacccggcattgtcagttgtgaaactaccagacacatccactgtaggtgtgatactccagaattgaaatatttccaaatgatgtgaaggtaacaaacattttcaggagagtgcagatgatcagattggaactatacatgatgcctgggcatctcatgcggacctgactgaatttgacaagagtcttctcgctcattatctgcaatcaactcatctctctcttgcaaatagacatggtaacacccgtctatggcgcatatcggtccctcgcattgcagcgtcgaactctttcctgcgccatggcatcctcgccctctcagctcagcaccttctcaacgcggagcaaagtcagagtactgatcgccaacgattaatgggaacggcctctgagcatcatggcaaggcgatggcggcatttcaggccgctatcgatgcaaagccgtcttcagcactcgaatgtcacggcattattgcttttatacatgttaatacactgctatacttttcaaattatggaaaggattcgtcttctggggttgaggacctgtttctcgcagatgccagccgacctgatcttggttattcatcaccttggctacactatgtacggcatggctgtcacctcgtgtgcggcttctgggacacgattggtaacgggccgctagcctctctcgctgcgtcgtgggacatacccatcatgatggaggatgaacggccatcccggatagctaccattttgctatccgctctggatcacgattgctttgatggataccaagtatctgatcaaatccaaaatgtttatgttcaagctgctagtgagttggcgcttgcgatcaatgcagctcaaaagtttgggtctgcgctgacaatctgggacgcaatccggttatggcctttgactctctcactagacttcgttaatgaggtcaagaaagagacgcctcgttctatgattttgctggcctgctactgtatcattttggagaagttagacgatgcttggttcgcagaggggctatctaaaaggttgctttccctcgcccgtacgaaactccagaatggtcaaagggagcttttacagcagattacacagcgcattgcgtctatccttagatagtctataacagagccttcaaaatacaaaacgttaccagagtctcattctctcttttgtctcagctgggttaagccttcaagaattccaacagcgcagagctcacaccttcccgatcctcatgcatcatccagtgccctgcatcgacagtcttctccgtgtaccctcccgccgcccagagctccgtctgagcccgaatctgatctgctctggtcactgtatcctgcgtgccgccgagtgtaagcactggaaccttgatcgtgcggtgcttatcggtcaaacacgattcgtccttggcctgaacaccgcgaagcagagccttgtagtagttcatggacgcctggactgcacccttgcgactataaaccttcatccaggtctccttgtcctgctcggttaggtaatttgcaagaggcgttgtggtgtttgtctctagccaggcacgggctgtgccgagtcctgcaaggttctctgcccatttggagttgtcagtcggaaaggcgaggctaaagaaggattcaagctggacgagatatcagtatctttgtcgaagcaagggatggaagataggatgtcagatatgggtttgatcacgacttaccttggaggcggcaagatctgcggcgttgtaagagttgaagaagtaaaaataaccaaactgcatgtatcctagttggctcaggctcatggcattcaacaagtcgatgtctgtgaacactcccggcgcactataccccagtgagagaaaggctagtttctcaaaccggtcaggatgccacacggatgttctcgagagaaggttcgtaccccaatcgtggcctacgccaacgactgtctgcagaccctcattgtcgagtatttccatcaagtgcccaccgagccgtttgagattgtatgcctcgacttcgagtggcatgtcgctgtcaccatagcccagacagtcaggagcgaggacgccataaccagctgcagacaggtcggaaacctggtggcgccagtcgtggcggctggaagggtagccgtggaggaggagtactgtggtgttggtggtctcaccgctggcaggaatgtagtcgtaggcataagtgctgccatcgcgtgtagtaagtcttttggtctgaagggaagccactgcggctgtgcctagcagcgaggttgctgctaggaggtgtaaagcgatagggatcatattgttggctctgaagaactgcgtaatagtgtagttgatgaggaaggtatgagttggctgaagtagatgatattatcagccttcgtctggtctgtatttatactccattttgccttggagataaatcagtcatttgattctttattctcgcaagtcagcggtgccgttccggagccaacaacagagccagcatgggaggttgacattgttaactcaattgagcagttcatgggtcggtgataagacatggcctagtaatcccgccatcgtggatctcatagacggtgctgttccaaggggtgattggctcgaagactcccagggaccgggttctggtcagaaatcctcagtagctagggccccagggagaaatagactgcttggcacaaaatccctactagctcaatgttcggccatgaggtagttcaatagattattggacagttctgattagtctcaccatcaagctgtctagaagtacggaagatgaaacatgtctagcacagattgatgaacaactcttgcatgggtggtgactgatcaagccagaatcagctaaagaatttcgccacccctttgggattcatcctttcagccgccatcctagcgtcatactcttccttggtccttgatttttctgctctgtcaactaccaactgtctgtgctgctctgtattcctctgtttgttgctgagcagaacgttaggcgtattctggggctctggctgcctgtctcttgatctcaacctggcaaagaaccacattatgctcctcatccagctcgaattaagaaaagaaagaatcacgcttctgcaaccgcgacgcaatgcattcatcgatgtcttcaatttctacttgggtattgggcgatgatgttttgtactgtttgagatggttacttaataatatgcgtcaagttcttgcggctgttcttaaattcatgtagatccaaaattagtgccttgatatccacggcgacggtgtccaatcaacaactatggtgcttgattcgtcagcaaggttcaacatgcaactcgtcattttgaagccaagagctatgagagcagcaatagccggttcaaggctcgcgagctctgccattacacagtgttgcgaacgtctcgatgggggtcgatggaaagcggggtgaagaggaatgccaattggatagaattaagttgcgcattatgaatgtgtattattttttcatccacgaggtaagttaggtagctgtgtaagatatgtgagtgcacacacggcaaggtgacaaaatcgattcaagaaatgatgccttggacgctcccgcaattgctaggatttgttttcaatatcaaagccgaaccttatggctttgaataatctgctacgccaccacgctggacaaacagcatggaaacttccagtgcaccttgcgctactgacaagttccgttaaaaaagtcgtgttggaattggtgctgtgaccatggaggttacgtcacaacaatgggccaggggaaaatgtctgaatggccgcatcatgcctaaggctctggggtggtaagcttagagaagtagatgtgttcaatataatcaaagctattatgaatctgcggcttttttagacggccactgtggagataaaccgcggaagtcatgaccacaaacagaaggctaaaccggaactcacctcgggctccgcggaaatcgacccaacaagctaatataggcgggttgggccgcccagacactcgccctgcttttcgttcaaataatgactatacataggtctgggatgaactggtcatagctgtgggactcggtatccatctcacggtggcttccagtatttgcccaaaaacaaacaagggtaaacatcttgatcagctgaagtatcaaatgaggcagggaagaacatggaggcttcaaaaatccctagctcatgacacatcttaattaaatgcacctatcaattgcctgagcaacaggaaaaagaaaagaacgcctgcatcccaagcgccaactgatatctgactcagcgttccacgccgccaatgatctccttaagcaatctaaacccctcataatcctcatctttgcaatacaataaacacgtattcaagaacatctattaccaaacctagtcgcacgatgtccttcttactggaaatacctctggagatcagactggtggtcttccgctgggttatttgctccctgaacctgcctccctcgggtcccttagaaaaccgagcagaccgaaagatactgcaagatactgaggcggacggcgagtgcacttatgttggagtttggtatctcgtgccaaccaatcctgctctccctctcctcctagtcaataggcagattcacaatgaagccaagggactcctccctagcttatctacggactgtcacgtcgacgtcatgtacgtcaaagagtctggggcttggcctacctggtccatctccgctctgcctcagacacggtacacgggctctctttccgctacagttagaacgtttgaccctcctgatattttggagaacatgtatcgccacagagttatagtggacggtgatcatcgatcctcgactgtcctacactggtcattctactggatacttgcgaaatttctcgactacggacccggacttctacgtcccagcccttccgaacatagccggcctacaacatcttcacgatatgttgtcaacgaagtcatcattgatgtcgtggcacctagtggtggatcgggccacaagagcatactagtcgacgatagacgctatgaggtgacgaagaaaggactggaaaggtttccaatccacgataatgcctcgctaccgatcgaagagcgtctggcgatatatctatctggctatttggacagaatcctctcctttgacatcaatatggtggagaggggcctaatcctctatgagcaggtgatagacaaaatccttgtgacagtgaatgggaaagagttcagagtatttgaactcgaggctcgtctgaggaaggaggaagctcgttggagaaaggagataccggactccaacgagaaactgaaatcgttcctggagaaatggacacagtgggtggatgagagacggcagaaaatgagggaagggtccgagattgatgatgccagaaagcccgtttcccccctcccctcattctagttgcttttgttttttttgagttcaacgccgcgcagcccgttttgactcagctttagcgatgacacttgaatttagtcgtgataatgtaatcgagataccaatgaagttgaatccgatagtaacattatacaccatcatattgctttgcatcttcgaatacacacactaccatacacaaaaaaggcgcctggtcatcattgaagtgcaatgtcatttgccatcttatcccaagtacttaatcattatcaatcaagcaagccaactttgagagccaatcactatgccttcatatcattccattctactcaacattgcacggcaagtcgagcacaaccgtaaatccctctcttctctctccgccagggatgataaacactcagactagggacggggcgagtttgtggccacccggccaaatgtgcttaaaatacggccaatcaggccaaagtcagatatgcagtcaaaaccgaagtgagaaataccctccccctgacttaggtaattctagcctaggatccgttcacagttcccgcagtaagcgccgtcatgcagccgcgcctcagaggtcccacagcatccggtgcctggctgcgaatcaccacccaccctcattttaccgaagttcccgacaccacttggtgattcatagccgtccaaaaggcgctaagtagaacctggaaactgctggctctggcttgcattcacccgttctcaatatagccagttggaacaagactagcaaccaactgcataacatgtacgcaatggcctcagccgtgttaacgttcgcccagtatacatacactggaactcatcccaccatcaagtgaattttcacccactttctgctctagatgtcctctgttccactttcttccaaactctgacgtctctcaatacactttccatccagattatacttgatagtcacaggtttcgagaccccctttgtattttaatttttaagcaccaatcttgaacatgattcctcattcacgtgccaaaatggccagcagacaggaggcgaaagagatggttaagaaagctaacaaatacggccatcttgatgaagatattctcagccaacttgacaccgaaagtcgtcgtaagatagagcatgaatgggcgattttggagtcagtagcagggcaatccgtccagacgttagtatccattcagcctctaccaccccccaatgaacatactgactagaattcatagtcttgcccagcaaatatatggaagtgatgctagatttgtatttgagctgctccagaacgccgatgacaactctttcgagcaggcgacgaagaacggggatgacccgtacatatccttcgaggttcacccggatcgtatcattgttgaatgtaacgaggatgggttcggtgaaaaggatctgggcgcaatttgctcggttgggcgaagcaccaaagctggatattatggctatatcggcgctaaaggcatcggtttcaagtcggtctttggtgccgcctggaaggtttacatacaatcccgaaacttctctttctattttcgtcatgagaaaggagattcaggtctgggaatgttaaaacctatttggaaagagccagaggaggatggccctcttccatttacccgcatgactctctacatccacgagaaattggagcctgggaagctccagcatttgaagttaatcattgacaagcaatttgaggatttgcaagagacttgcctacttttcttaaagaatatcaagactatcaccgtgtcgaggtacaacaatgatggtagtctcaaatactccaagagcttcaaagccgcggatgctggtacaaacagagtttctctggagactgtatctgtaaccgagggacagcacataagagagcggcgatactatcacattacgaagcatacagcaacaaacattgccagaagcagcaaccgagatcctcccaagacagaggaggcacgccaagtatcaactactgctgaggtcgtcctggcattcccgctcaccgaaaaatctgaaccgttactagagaagcaagaattgtttgcctttcttcctgttagggagtcggaatacaaggtattgagacctttcgctgttctacattcaaacataaagctaacacaagtctcccacctgcttagtttatcattcaatccgatttcgataccagcgccaatcgacaggacattgtcacctcatcaaggaggaacatgagccttcaagatgggattgcttctgcctttgtgaaagcagttctgcatttctttcacgatcctgtgttatgctatcaatggccgcgatttctaccgtcaacagaagacagcagtaatagcttttggtcaagtctcaacgagaagatcaaggatcagatcttaagcacccctatcatgcggtcacgacatcgaatgcagcctcgtctcataaccaaggtttatcaactcagtagtgcgtccagcgacgaaaatggtgactgtttgtacgacgataccagcgaagatccatatatatccaaaatgtacgaacaaaacgatatatcgatactgcatagctatggactgaggttggagatgaggtgtgaggctctcaagttactaaagtatgatctcgatgcatcgaactccagaatgaaagacttctctaggagccagtcgtggcattcacgtgctgccattccgctggcagactgggccataggtcccaaattccagatcattacggaggttatacaaacactgcctcttatcccattgcagaatggcgactggacttctattagcagcggcctggtgtatctgcctacaactcattccgttccaataccgttggatttggggtacaggctacttgatccaagagctcttgttaacccggaccgtgagaagctattcaagcgcattggcgttattgaggcacaagttgaacagattcaaaactcgattgaagtgcgttacaacaaaaatggacaaaccatcaccctggagcagtctgtctcccacctccactacttgtacctcacacatcatgatggcaacaggcgctcaaaagttgacaaccttgtcatttatacagaagagagagttctcagagacccaaagagaaagtatgtctatgttgcaaatgaccatccttgcggaccgaaacggttattggaaccgacagaaactgcgccgggctaccccgtgaattacctacattcttcttattttgaaaacccgccagcgaatgggccaggtctgctttcgtgggaagattggctatataccttcgtcaacatccagaggcgtctgccagttgctcgagtggacaagctctcaggtgctttcgagtatattgctaggcatcgtccagacaagttccttgataccctagagtttctttggaagaatcagagatcatcagtgagggggaacgaaaacattaagaaactaatccaacgactatggaactgcgaacattgcgagacagggccacttttatgccagggcctaagctttgatcaaccctggcttccagtccctcatctaaaacagattttcgccaaatatactcatggtaacgtattctttccgtttcttcggatagacggctttgataccgaagttgttgaaggaaagtgggcgtttctccacagagacttcaacgttggcaaaaatgacgatatcacattctaccttgaggttctatctcgcttgtcccggtcaggggaggggatagagatggttggtggtatatatgaaatttaccagacaattgaagcgaaaatcacgatcgcgccgaaccgagaaacggcattgaaagacgtcaggtaggtatcccctagctttgctccgcatattaaagccacgaataataatgatatcgaagggactacatgttcaagaattgtctcatactatcaccaaagtatcagacatcatctggggaatttcttgatggggaatttatggatgatgactacgatatccgatgggaaggccccccagacatggagtctatcgcctgtgttgcccagcggtatagacaattcctagatgttggtcaaatgcaaaaactgactatatttttccactatactctgggtattcaagacgtctcatgggaggacattgtgaaggagcttgactgcacaagagggtggaatgaggaagatggagagcaagtcaattttgatcgggtcaaagggctctatcagttcatcgcccgttccaaagcacctaaggccgaggtaaagtatgtttaaatcctttacattcagtttcagtcaattttcactaaaacacagaaaacaggagaattttcatcaaagatcgacttatctatgccaccagacacggagttgctggctggtacaggtcgtccgattgtttgtggtcaagcacatcggagatacgtggaaaagtcacactaaataatgactacgatagcctggagacgtttttcacggggactttgggtgttcaatccctcacacttcagatgatatacgacgagcttcggcatgccggcgcccaaaaatccaccaaggatattaaagacgacatttggtcgctcaatgcgctcctacagaccgatcgaacgcacattgacccagctcctttactaagagaagctattctccccgttatataccctgatgggagatcagctctaagaaacatcgacgcagtatttgctgttggtgatgatcgacagcttcgtggtcgcttacaagcctacgtcaacctgcttgactacgattttaaagagattcgactgctaaagccctttatttgctgggcaaaattagaggaaagatatctttctcagtctgtcagggagtttacaagagtttctcccctagcaaccaggcgacctatcacagaagacaagtatgacatcagtcgcaaagcgtacgcgattctacggtaagtgctcatcatttcatagctgcaatggctaatgctgaaataaaaacagtctcgccaaaacttttcagagtcccaagtatgatgaaggtgaccctgagtctctctataaagtcctccgcgaggccgaggtcatccaatctgacgctatctcttctgttatctcaatatctcaagatggaaagtcgattgaacttgaggagactgcaggattgtgccatattgatgatttacagaagaaactcaaaatttatgtgccgctaaacaagaagcagcggaacctctccttcagttctgtccttccgaacaagttggccgactggatcatgagggagtgggattcaaacatatctgacaaggaagacaaagatgggatccacattctcagaacgatcttgtcctgcgatttggctattgttgacgatatcctgaatcacaacagcgtctttgaggtgggaatagagaatcgagaccctcaatataaccaagaaagcgacagtgacgacagccctctcaatgacgaggattctgaggcctctttaactcaaatgacaccgtcgagatcctctagggcagtcacgactgacttatatggcgctactcctatcagagagggtgctctctctccaagggctcaccttcgtggctcttccgagcctggaacaacaaatgatggtgataatcaccttgtagtcgagagaacccaagcagtttcccgtgaagaaaatcgcaatgcgcgtgcgtcagtttggaaccaagatcaaccaagtccacaagggacgtcacaagcccaagacgctgcatacttgaggcttctctatcgtgtcatagcagcgtctcgaagtgccgtatttccctctctaggagcctttgacatgacggggctgattaatgagctgcctaatgttgggaacctgtacgaatcatttgatggcctagacgtgcctacaagattccgctccactagccaacttgagagagataagatggtcggagccgccggagagctttatgtaagtctgatactatgaaaagatgggaatactcagttactaactacaggtgtaggtatttgagcttctctccgctcttcagctcccagggtggagtcgtggcaactggcagagtactatcaggaaatatgtcaccgggcatccagactaccatgatatgagaccatggtctcagcgagaaacggccgatatcgtgtacccggacgtacgtggagagttcactaccctactaattgacaacggttatctcggtgaggagtggcgagccgctcgtcctaagtacctccttgaggtcaagaccagcaccgggccgcttgccactcctttttacatgagcaagaaccaataccaacttgtgagttattctttaggcaaacttcatccagtgcgcaatcgcgactgacctcgacaagatgcaaaatattcacaacattgaggatcgttctgaagtttacatgatactccgtgtcttctggcttaatggtaacaacattgggatgagagtgtatctggaccctgaacagatgagacaagaagggggtttgattttcactggggaaacttggtcaattactccaggcgttcgtgagaggaattgatcgatggcctgtccaaagcccaatggactttcgaccttgcttcagaaaccattttcacatagaatccgatggtctcatgccttagagatgatgatatcttcacaccgatctaaccctctcaagagaaccttttcgaccctcaggggtcaccaagtgtatattagtatcagtagctccctaatgacagcacagagaccctccctaatggatggtggaatatcgcgatgacttgtccattggcgctgcaaccagtaaatgactgcctgctggcctttaacttggccagtacgaggacctcctgatcattcgtgaagttctgacacaattttgccatctcatacagcctcaccctcgggtcgaataaccgattttcagtctggattttggaaatcattgatccatatggctcacattcatttccacgatacaaagaaccaacctaggctagaatcgcccctttgtgcttctgtcaacctagcatgcatccgtagtaacttaaggaaaagtcgacagatgagtcataattcgatgagtagcccacctaccggattttggaaacacgaaggtatatttacatgctgttagtgaggtgtcttctgtagttattgcgagacagctgggttgcgggctcctcgagccaagatgaaagccatagctctgaggtaagagtcgggctcctgagatttcctttcatggtaaatattcgacaatagcggccaggtagctacggagttgcgaggtcctaaattattgcttcgaatacaggtcgattagtgtttccaagaagagaacattcagcccagcttcggcatggagctgaatgggggcctcctgtagcgcttaatccctaatgggcgcatttcttaccggcaaagggtccagtattgcacggtaaaaaacagtccacgaggcagcctctggctgacgtcgcatgtagcccgtgtcatcctctgttcgggttgcgacgtggcattaagtggaactgtaagggatacgaatcacaatggacgcccgatgcaagcaaacaagactggcatgggttgatgaattacatgcatcgatggagatattgatggataccaaatgatgttccctggccaagagagcacgcccgcgatgctaaaggagtctgtctgacccctgcctggcacaccacgggtttggtgcagtatccttggattcagatgattcccggcctgcctaagctcgctccctgagccccgatggaagctgaatgttcgctggcctaccgagtaaatgccacctaagcattccatgaccactgtatggcgtgtaagcctgcctgatcccagctccgacttttttacgcacgcccatcccaaacaacgaacgcggcgagcgggaatgccagatgtcatgccgcgccgcgtaaattgaaatagaatcacaatttgcctctataccccagtgttcggcctttctgccgaccggatgatactcgccacaaagagccatgaatagattttaagttgcctaggaggcaaagtgcctccttgattagtgtgccccagatctcgaatgcgtgatgttacgggcagtggcgagaaatgcaattgtcaattcatagatagctacagcggaccaattcttgctaatctgtccacgcatgtgtggaaagagacgaggaacgccgctacagaaggtacgtacagaaaaatatggtatcagaagttattttccagagactattttacaaagataatttgacagatgatttggcagagatggtttggcagagatggtttggcagagatggtttggcagagatgatttgacagaaatgatcttacagaaatccagagaattcaggcagtgaactgggaggtcacatggtggaccaacgatacgtcccgaagcaccttcttgtgataattagccaattccccatggtataaggtgcataattgagctgccccatccctagaggcgcagccagtgtcctttgatcgccgtctttccgcgtttgtgagagttgagcgaggtattttgaggggctgctggaccctgcaagatccatgtccgccgtccgaggtgtcagagtagcggggtaccttgacatttctgttcttacaactttcggaatgcaactcaagcaagctctcatttggtcgatgagggctcgctttggttcgctctggttcgccctgcgccggctgcctcgcatcaccagccgccccagcgggaccgtcccatgcacgtgccgtctcgcaccgccctccgtcggtgagagaggcaagggtatggttaatactacccattatcctgctcttttgctttcagtgtggctctgtgacgattatgacccacgggatgtcccgcggcataataggcggcttctatgccaacttcatcagtattggaactatttaagtacagcgtttgcccctggttgattgagcgattcatgtccaaaggatgagccagcagtcctcttcgcgccagtgtttctttcctgtctcaagctgcataattatcctcctccgcctgcttccacatctgccatgagttccatcgtcaccaacaaatcacctaagtcaacacgtcgacgggctagaccattaagccacttctcagctcctaatccatttggtaaatttctttctctccaacgatataaatctcagaaaagtatccaggtttaaatgtttcttagtgctaacagtactcggtcagactctcccccttattcaattgcgtcgactaccatggtcactcttgatgcagcggacgaaattcatgcattaccttcatcgccttcctttgcctgccctttttacaaattcaaccctcaggtatacgacgaatgcaaaaagcaccggtttcccagaatatcagacatcaaacaacaccttattcgacgacactcgcttccaccctatttttgcccagcatgctggatctcattcatggatgaacaatccagaattcaccacccttgccgaggcgagggtcagtacgaattaaggccagaagggctatctcctgaggaaatacaagttgtccgcctgattcgaggggggagtagcgaagctcagtggtttgctatctggcgccgcttgttccctcgttacaccgtgcctcagtccccctatattcaacccaacaatatcgaggaagttgtctccctgctatcaccttacgtggaggcggtattccatgcctccttgccctctcttcctagcaatgagctaggaataagcagttcttttgtgacgaggactctcaccgacgcttgccaaatttacttccaaagccttccagcctcgcggcacgactcccctcctctacctccagactgtcccatcgtccctcgcgagggtagatatcttttcaatgggatgccgctaaatgacgggaatgatattcccatttcgcatgcgtatccgactcatataacccccgtcccaagggggaacttgaggccgccacccgcaaatgcgatcattaatcctgcttattggctattcagcacctccgaacctacacaagctttatcgcaagacgagtgagaaaactcacttaataggtatgatttcaaacacctcacgttcatcttgaggcactctccgccgtgttgatgctacggctcagagtttttatttttctacatcctccaattttaccaccttctttgttattatccttataatacatatttttttccttcgttatttattttttttgggatttgagggagcaagcaaacgatttgacatctaaacggtctgttcagcaataaatgtgaatctacatgacgcatgggtcaatgggaggaaaatcaagcgatgtttaggttcagggggatgatatggcgggtccggatcaatgaaatatcacgactttcttttagcatatatctattttacaatgatacaatcactttactctaggtagtctgttcagcaggtcatgtacgtaaacttactcttcgtaaaaacgaatcgatagacaaatctccgcaacattgccccaaatccgaggccctagccggaatgagcggaaaccaaatgcttccaagcagccattttctctataacctaatcacatgcgaccttgataatgatgtcagccggtccaggagcaaggggtcaccttagccgctgttcgccaagcaacggcatggatggtatcaggttcagtacgcgaataaccaacgagactgactcagcataagtgacggcaagagagccacactttgtcgatgtgctgacgaccacccatgtcaaatctttttgcaccggaacaccaatttgggccacagaggggggatcagccaaccatattcttcattcttccttccgagcgagctgcaagtaatagccaaccgattcagggcgctaactgttgatttctgtggcatcttacatccatccgtgagcctttgggcctgatgcatcctacaatcaaggttagcattgcaacgctagtcatcacctctcgtatccggatacgaggacattaggagtattccctctctctgttgccgacttcatgtcactctttttgatcttggtatctgattattcgtatctgcagactttcggttctctcgtatccatatatatgtcttaaatatagatatcggccatctacccttccacaatattgaatggacgagtcagatgtagtgcgagagtggaaaatcgaataacaatatgatgatcgcaaagcgaaatgcctagctcgcggtagtaaatacaagtggtagaaataaatgtaaatagccagagtctaatctacatgctgtatgtttcatcttccctgaagatattaatctagatatggaaagagctgggcttgtaggtagcagcgccgtttcgctgagtagttactacatggatgacagcgaggcgaggatgtttaccacagagaaggccagtctccaaaatccggaccatcactgccaatgatagatcagttcattgttcttattttattcttcaaaagagctacatgtcatcaagaatggggggcttataacgagtcgacatgcctccatcgagtactacatggagactcaataaccagcatttacttccggcaaaccaccacaatggcctccatcggtagcccgaatccaggctcgccactcagcatcgtgtactccttcgcctccagctcgagtttctccgctaccgccttcttaaatgcgtctttgtcggcctccggccagtctgctgtcaacatcttcccagccatatccatcataaagtccaacagcatctccttctttttggcgccatactgcaccggtaaggtcgacacctcaatcgtatcgtccttgaagccggcatcagacagaaccttgcgcaggtgctctggatcatgccacacctctggcaatgggaacctcacgggctcgtcatctgggcggacggccacgtgggccggcctaaacaccaggtcacgatggcccagcttcgaccaggatgtgacgacggctgtgcccccggggcggagcgtgcggtaaatctccgcagcgccttgggcggggttggtgaagaacatgatgcccatattggtgaagctgtgggagaatttggcgtcggggaactccagcttctcgccgggcatcacgtcgaactcgacggggttagaggtggctttgtccttgaggttctgctttgcgatgccgaccatgcttgtgacggcgtcaacggcgtggatggtggcggcagggtacttcttcaggatttcatcggcgacaacgcctgagccacatgcattatcgaggatgacggcagagggatcgcccagggagggggtaacaagagatacgaggtggacggcaaccatgcgtgtggcgccgccagtgctcgcttcatagttggcggcaagagcctcgaagtgctcaaccgccgtcgtctttaattcggacattttggtatagagttatgggagaagtgataggttatcaagttggtgggaagttttatcactgcacgccgacaggttgtggactaaggataaaggccaatgaacctaaagaagcatgagttaagaggaggattatatgggagaaccctgatgggtttagctcataaatggcaagtatgtctccgagttcaggaaagtctccgagtgttgagacgctagtgtgcttatgactggagctcattcccctgccgaagtcaaataatctggtcgactgatggggctagatgatcaacaactttattaatagcatcgagacacagtagggctgacgatgaatctcaatggtaaagaagaaatcacattacttgctaaataaacgtaaaaaagaaaacagaaagttgagacagagcctatcccctttagccctgctgccttgccatgccttgaagccacgcacaaccatgaacttggcaactaccacgtatatcactgtgatagcaacttcatgagtgacagctacaaggacttcatctgacacattttcatccatggcgagattctatcccagagtaagtaaccaagtcactagaccgaacaagttcatgcgtatctgtgagatggtccacgacggcaaccaagtcatcccacctactgcggggccataccgcttttcacgctgacgattcaccgcaacgtgcaagtgtactggtcctagcacggataagtcggggctgtgctgcgctctcggctcgagcgttagctggctttcagcacagagctggcagatagaggcccaaaacgaatcgcggtggcccttggcatcatctctcccaccgcaccagaacaaatttggatttccaatgtcgtaggagctttggttgttgaaggctccgtttttcgatccataagagattcgttaatccaacctagctaatcacaggcacagtggggaataagcgaagccggaacggaatggtgctcaagcattggtctgtagtcatcttcataggtcgaaagaagcgtcatgatttgggttgcgatggtagaataattccactactacatcatccgcttcagacctaaggatagacaaagggctccggccttctttgtctaaagcctccatgtcggcgccatggcgaacgagaagctggataatgtcagtccacttggcgccgtggaccgctgtgagtaggtgcagtgcggtttgtccgtcctcgtccacagcataaacatttgctccgtggttcaggagaaaatctaccgcctttattgaatgtcccaccacagcctccatgagaggcgtgcgcccatgttcgtcaggctcgttaatcgaggctccatgctggatcattatctccatcagcttgaggtgtccgaacaacgcgcagtaatgcatggcgcttcgtccctgctcgttgaattttccaagatctgctccaaagcggagaaggagatcagtctgatccgcggagcgccgtgagattgccatctgtatcatagacagcccactattgggcaggcagttggggtctgctccgtgctctagcagaacctccatcgcttttagcgaggagcatcttactgcgagaaacaggggtgtctgtccctggatgtccttcaagttaatatccgcgccacgctcgatgagcatccccacgagtgaagctcggcttgggtcagaggaagccaggtgcaggagcgtctctcgtctcagattcaagtcattgatatcggctccatgtgcaagaaagacctcgaccaggtctgaggagactttggcataatgaagcggggtattgccttcgaggtctctggtcatctcaactccctgtgcgaacaggaactcggccacttgtgccggctccctcgtctttaatgacatgtagagcgagttacggccatgaaagttcgtcgcgctgacacgagcacctgtgcgaacgagtaatttcgtcatctcaagtgtcccgcattcgaggctggcagtttgtaaaggggtgtgtccccgtcggtcccgagtgttcacgtccgcgccattcgcagcaagcagctcgactacatcgcaataaccataacggacggccgaatgaaacggggtgaagttgttcatttctctgaagcgaacatctgctccgtactcaacaataactcgtacagtctcgacgtaatcctctcggcttgccgtctgccgggccctcgagaagtagtggtctggtgcgcaggcatatcctagtggcgttcgtccaaatttatccatggccataagattagccccgtaatccaagagcagtctgaccagccgcggattgccatagctcgctgcaatgtgtagtggcgtcctgtcgtagcggctccacgcttcagtcccgattctgcctgtgtttagaagtatcttgacagtatcgtactgcgcggcttttgctgcgacatacaaagggcaccggtcatcctcatcagtttccatgctctcaaagccgccgtgtttcaatttgccctccagcagggtattgagaagatcggcttggccaagctccgccgcgagagtaacatgacgcagctgcacaaggtcaacgcccacgctgagtgctcttcggattgtttctggccgcccggcttcgatggcccatgtcacagccgagccatggtggtggaaatgattgctagcatagaggtgcgaaatgaccgtgctgaacagcgaccaactcgtccggctcagagaactgatgtccctttcgtcaacgagatgttcaacaatgccctgcagtagctcgactggcaattcgaggagatgcattttgaccacgatgatgatgcagtggaagaggcccgaccgagctggcacagaaaaaaacaatgccttaggtatcaacagcagccaaccacaagcccccaggtccgcttttcggagcgtgtttgcctaccctatgctgctgttaagaatcctgggtgtgaccatggcgaaaagcttacagtcggcaaatgtgatatgtgatagagtgaaagggcctaatgtgatacagaacagagaaataaaacatttctaacatctgcaaagccatggttgaggcgcaaaccttcttttaagctttcgggatgaacgctaggcttttctgaacggccgtgtttgatggtaaaaccatcagaggctgtgaaatttttcttttttttagatgaaaatgaaaattatccgcgaagatgtcctagagcaacatacgcaattcacaccaaaacagatattcttgggatttccaagtcgctatcgaggcacaggaagaattagcatagtctttaaaccccaaggaggatagagcctaaggaggcaaaaggaaggagttggcttgtctaacggcatttgatcctgagtttgtagaagggaaataatgggcggacactcggattcttagaacgaaaatgatgatcgcttgtggtggtaatttttcgctcccagttgaacttgatgcatcttctcgggaaaaccccagagacagagagagccgtcgatcgaaagaacaactctcatgggtattaatagcttgatctttaatggggtgtcaaagctccaaggagggagagggggacaaaagaagaaacagggaaacggccacgagaaggatggatccagcaaggcttcattgactctaatgacagtgtatggaaaattagagccaacttcaatgctcatatacaattattactccatttcctacacaatatctgggcagacattacctcggctatgcttgctctcagatgttctccactatcatggtgagccactgcgcttgctcagcagatgtctccaaggatgtctatccgggtcatctgaggtattagtgacccttttttgagtagtagatcaaaaaggaagatgttgacaaatcgattggctaaccaagaagtgatgtttctgtccccgcccagtacagctaaggattgcccagcgcatctctcggacatcaatcagcaccctggccaggggtcttcggcggtcaaggctgcaggaagtcaaatgatgatgaacttcaggcaaagaagacttgttccactagacacccaagatttgaccacttcggattggctagaagtgctgctgagactccgcgtggtaaagcaaaccattgattattactatgggtctttggtaacgtcatgcggcattaatctccataaagaggcaagaggcgaacacttggcaactatataataacagagcaggcctcgtacggggatgcctgagggcaaaaaagtttgatatacagaaattatcatcgcttcaaagcatccctgtaaatattgtgcgatctgtgagaacaactacaacggagactttataaaatggcacagaaggtagcgcaagggttctatggaggggatggagtgatttagggaggaattttcccccctgcccgcagtgatgtacgtcgttacagcaagaaggatattcaagaaccgtgccataaggatatcctagcaaatggtggaactcttcaaatttgctatgactcgcgtctgttgtcaccgcttgggcttcttccaaagactaatatggcgtgaatgtgagtacttttagtttagatactttcagccatctgaatccctccacagtacacacgggcacctaagctcaatcgagatcaatcgagggaagacataacacaggaatgtgaatctcgcttgcaagatcgctcgtcttagcactttgtagatatcccttcaatgagattgtaataaggggttgaaatcacttcgactccccacaaataagtttttagcgtcaatttatcaaggcttgttgaatgagaataagttgttcagacctaatgtcacccaatcttcctttgtaagatacaaagacatctaaacgatatcaaacctgtctcactaagagacaacctggatcgtggtaagtggattagccttgactcgccgactccatcgttgctcctctagtgatgggcactaccaaaggcggtaattttcgacgattcagtcagtagggatatcttagaccccgagctaacagagtccaggacgggccactgcgtaacctcgtagaactaccaagaacaggcatcattgcccgagggctaatccagatctaggacaagcccataggccggggtggggcagcaaaccacgcttcgcctctcaagagcttgcttcaagtattcccagacacctgatgcctaccccatgcggggcatgacttggggttcttgatgattgttcccataagacacgggggtggagccaagattacggcgaatattgtccaatttggtagtatgcactaccccataccccggattctctgacttagcactcatgtgcacaattttctccaggacttgactttcctaaatctaacttcctctttgatctgaatctgtatatattctcggccatgattgcttttttggatttggtcttctgcagaaccaattcttttcacgttcggatctagttttattcaacactgcattctactttcctttttgaagacaaaacggcaactgacagcctttgtcaaccatggcagaccaggcgaagcatattgttggtggggatcagaagccagatgcagagcatctggacagtgcttcttctatccataacgtcgaccatgaccccgtcgttcttgacgacgtgtcctacggaccgacaggtgttcgtgggcttttcatctctccctatgtctccggagccgccttcctcgcttccctcggaggcttctccttcggctatgaccaaggtgtcatctctatcatcaatgtgatgccccagtttcacgccgtcttcccacaaacggagacggcttttggtaccagctttatgactggtatgcttctccttggtgccttcatcggttgcatctttatgccatacgtggctgataagatatcccgaaaatgggcattgacccttgttgtcgtcatcttcaacatcggtgctattctacagacagcggctgttaattacaccatgttagttgttggtagaaccatcggcggcatcggcgtgggaactctcgctatggtatgtgacatttttcagactctgttgttgtttgtttcggatcgtctagttctagttatcgctaacacgaataaacagggagcgccgctttacatttctgagatctcgccgcccaacctgcgaggtacactcctcgtccttgagtcaatctcaatcgtttccggctgtgtgatctcgtactggatcacatatggcacccgatatatgtctggtgaagcttcttttcgactacccttgggacttcagatggttggcgcaactgggctgggttttggtatccacttcttcccttactcacctcgatggctagccctcgtgggcaaaaatactgaagcactagccagtctctgtaagcttcgctgcctccctgaaacggatgatagggtcaggagcgagtaccagtcgattgttaccgaggttgagtttcagagacttatggaggatgccaagcaccccggcgttcagggcctaaaactcgaaatccttcagtggcttgatctctttgaccgaaagaagtggcggcgcgtggccgttggttgcggtgtctgcttcttccagcagttttctgggatcaacgcattcatctactacgccccaaccctgtttcgctccatcggtcagtcttatgagatgtcattgatcctttctggaatcttcaacattcttcagcttgtcgccgttgctgtatgtcttgtcatcatcgataaagtcggtagacgacccttagccattgtcggtggcttcggaacagcaggttgctacgtcatcatcgcggtcctcgccggtctgtattcaaaggactgggagtccaatccttccgcaggctgggcttgtgtcgccatggcattcctcttcatcctcatcttcggagcctcttactcgccccttggctgggcccttccccctgaggtcttctccacgagttcccgagccaagggtgtggccctcgctacatgtgtcaattggctgtccaacttcactgtgggggttgctaccccacccatgcttgaggctattggtttcggtgcctacgtcttcttcgctgtattctgcggcctcgccggcgtctgggcttggcttttggttcccgagacaatgggcaagactcttgagcagatggatgagatctttggtgatacaagtggacaggaagagcaggatatcatgaggcgggcggttcgggctgctgagatgacacatcgccagcacgcctagccatctcgaaaaggaactccaagccttctggaggggtctcgaggacttgattgattctgcctaagtgtccggacctatggcaaatgaagggacatgtttataaagcgccagtttgaggacattttttcgtataacattatgatgggccaatcatctctgggctctctcttgcataatgtagttagcctaataagttctcgctagcttgatattattggcgatggcggtgatattatggcgtcgttattcggattagttgaatgttttattcgaacaggccaaaggctgccctttgaatcgaatggcatattcagctgacatctgaggattgctgccaagaccggagagagcttgatgccgtagaaggtaatgtaggagatgatagctagacttgatggactcaaaagcttcactgactggaatatatcgatagtaaccgccaccatggatcccacgtggcaaacgtcagggtcatttcaggtctatactattgaacaaaccaaactactctctataacttcgctgagactgtccatcaatgacctacagtgagaattcatgcaaatgggagtcgatgatttatttatgatttgttcaattcagttacagaccgggcactcacccatgtgtattattattatcttaccctggctacattatgggacagtgagaaggcccactggaagagcctaaagggcactaatctatagtacggggcttactgagactcagggtgcagtatatgtacccaagacagatacatgcctcagtgttgcaactcatgtggtttcaagacgataggacataaataatgttacctaacttgatcactgcgtgccttagtacgtcatagctatcaaatgcaaagtgactgtgcataagccctcgagacgaagcggcctgtcacggagggttcgagcggtcagcacgtagcacgtgccatcaatgtaatgtccaatcatgcttgaagtaaaattaaaacgctccttcgcaaattcacggtctgccagtttatcacaacatcactgtcgacagcaaaacaacatggagttccccgaggagatctggacgcggatattctcccaattgatcccccagaatgatcctcatagcgatgagaaagactatccataccggcctctccgcacactgtgcctcgtcagccgcaggtttcgccgccttgctcagccaattctccaccacacggtcttcatggtggaagcccggacaccaaaacagcgcgggataaagctcctaggaaccctacatcagtccccttctctggcccgcgctgttcgcagcctgtccttggctagcttctgcatatcggtcgaggatcagaaatttccagacaaggcgaagcttttggacgacgtacttcgatctctagacatcccgtctctcctcagggaccagcttgacattaagtccttttcccaagaagacgtggacggggtgccaatgattctcgcactcaccacagcggtccagcatgttgacatcaccatgaccgaattggactggcatatgcacatttcccaccagctcgcaggctcaatgcaaccagacgaaccaaacccgcctcgtaactacgcaaattacgggttgccgaatctcaaacacatctcgatcaatgccgagtatagcccaatgaacaccagcatttcctacgtggagcctgcgctactacgttcagatctgaccagcctacgtctcgcacatgttaattggcactcggcctgggtagaagccgttgcgagacccagccgcacttacaatctgcattctctcatccttgatgactgcattgtggatgaggttactctcaaggatatcttaacgcggtatcccaaactccggcgtctgtctctcatgtgtgcagatggcaactcagccgtcgaccccgatgactacgacgggggcgacgaagccccttggacctggcgcagcggccccttcggagatgtgttaagggagtatggtaaacagctggaagagtttactcttttgacagattttcaccgtgagcgctcctatgcattcagtaccgatgaggatgagactattttggggtcttttcatgatttctcatcactccgtaagatggaagtcagcttccgagagttgttcgggcaaggggatggagatggaagggtgaatatggacatgggcctgttgcctcctaatttagaggagattgtcatcccaagtagccatggtgcgtactttggcgaggcgatagctctgatacagagccattcgttacccaagctccgccgggtcaccctgcgattcacgtgtggctgtctttgggacttgatggctatttcggagaaagagattcccgggtggacgtacttggaacgaaagttgcttgataagatacctatcaaggtccgctatctgaattttgttaaacttcccattgagcagaatctgctctagatatgtccaaagataggtcatatcatgccaatcgttcagcctcctttgttcttatcaagagacttaatgaaacccgagaggcgtttcctccaccctgtcttcttcactccgccgctgccagtctgggaagccccttttgtctgagcttcaacttttgctgcctccgcagccttctgctcttgctcagccgtatgctcccggtgcaatctaatcaagttgtgaaaggcctcatcgatgttgtgagtggttttcgccgaggtctcaatgaaggtagagttcaactctttggccagcgcctccgcttcctcgttagagacttcgcggtcagtagatgatagatcgcatttatttcccaccaatattagtggtacttttgatttcttgatgttttggatctgccggtaatactttctgacctttgcgaacgagttcctggatgtaatgctgaagacgaggaggaaagcatccccttcccggatccattggtcccgcaaggctacgtactcgtcttgaccagccgtgtccaagacctctaccatgcacggtgtgccgtctacgacagtctgcttcctgtaatcctcaccaccagtggggtcatactgtgcaaacggtcagcgactttcatctctcagctcataccacaacggtgagcctacagtttccacgtaatactgtacgacgaattgattagtgatggcagtcttgccaacaccaccgtcgccaagtatcacgaccttgtggagaagcattcttccttgtctcaaatggttggaggctgacatcttgctgggtgcatttaacaattaacttgcacttgtagagaagagaatgaggggaaaaggaagacatacgatgttattcagaagaggggaatcagcgtacagggaccacccctggtcctcagacagacgccaatgctacattgaaggggccaagatagaagcagtcagcactacatcacggttgggaatttaagcagccaacggggaacatgtccctgtgaagccgggtttcagcgagcaccaagatctgcggcacaggctccatgatttgatgaagtggcccaagtacgaaaagcgtggattattctctatcatgcacagtaacctccgtccacaagaatacctgaacaaatcgcgaaggaactagcatcactagccagaaacgcgtatattgccttcagttctttgcgccccatcggtgtcatgtacctccatgtttgcttcgtcccagcgggcatataatcggaaagtcacctttcaatagatccaggcgacgcagagtttaggcgagcgaagtcccgcaatccgtttgccagagatttggcaagttgggcagcagattttctcttggggaaaattggtgatgtgtcccaaaatggacaatgtgatgatgaacgatccagatcctcgactcttgaattgagtcccgacgatctttcactaatgtaatgttccagtaagaccagcctcaatgaacttctcccagctctctacagattcatcaaggatcccagagtaagcagcctgacctgcattggcgacaaaaaggtcaagttgactaaagtcgctcaatacatcctccaaggccttttgaactgaactccagctgcgagcatcagactggtagggtagtcctcggcattaacaccatataattctgcgagctcagtagcattcctgatacaggtttcttctcgcgaaaagtgaaagtgcgacgtcggcacccaactcagcgcaggctcgggcagattccaagccaatgcccatgggtccagatgcgccagtgacaatcacaactttgcaggctgaacatatcagccagcttttctgccttggtcgttagtaaaggtatgacggtggtggtgttgtgagagggtgattgataggaggatgaagtggaatgtgtgtattgggaggactgggatcttatgagattgggtaagtctctctcagaccagttactatgaatataatctaacattgaatgaatatgaataagcaaatcctcttcaccatcgacacgactccaccgctcaatgcggcctttctggctatcgatcccatgaccatcaattctgagtgtgaactccaactagacaagcaataccgagaactgaactttgccaagctaaggatcatcttaattgttcgcggatgcgtcggctacgattcctttcttggtaatttatgcgtctccataatttcactccacaagctacctagctcgatgctcgatgatgctgccactacttgtgatggcatggtgatggcactctacggcttccttcccttccccgcacaaatacgggggcaaaataggatcttgcggggaaaatacaccagctattcttcgcatatcataaagtcatggctactaccggtggttagtattagttaccagcccttcctgttccctgataccttggatcaaatcttcggttctgaaacaccaagtcgatcatattgaaatctggtccgttaggagaaaatggtgtcagaaacctcagatctcgctccgagattggagaacgtcgggattcatatcgatctcgaacaaaagctctaccttagtgcagcctctcctaatttggaagaggtcctaaacgggtcgagcctcaagcccggcgaggtcaccgtatcgatcaagtctaccggtatctgcgggtaagaacctaccggcaacagttttgacggttttctttttgctcgcaactccacctccacataacttcaatgctgattcaaggttgtttgtagttctgatatacatttctggaaacacggaggtatcgggccgtggaaagtgactggacctcatattctaggccatgaatccgccggtgtcgtgatagcagtccatcctgacgtcaagaatctggtggttggagaccgggttgctattgagcctcacattatctgcggtgtctgcgagccttgcctcactggccgctacaacggctgcaaagacctgattttccgatcctcgcctccctcgcacggtcttctacggcgatatgtcaatcacccagcgatgtggtgccacaagattggggatctttcatacgacgaaggcgcccttctcgagcccctcagcgttgcgctcactgcagtcacaaggtctggagtcaagatcggtgatccagtcctcgtttgcggagcaggtccaattggccttatcaccttagatgtctgccgagcagccggggcctggccaatcgctataacagacattgatccgaagcgtctggagtttgccaagacaatcatgcctgatgtgcggactcacctggtggagaagggccaatcccccgaggaggttgcagcaaagattcatcaagccatgggagatggcgtcgaagttgctgttgctctcgaatgcactggtgtcgagagttctgtcagtaatgctatccagtctgtcaagttcggagggaaagtattcattatcggcgttggcaaggagaagatggagattccatttatgcgttgcagtgcacaagaagtccaggtggagtttcaacaacgttatgtcaacatgtggccacgagcaatccgagttctctcgagcgggatggttaacctgaagagacttgtgactcatgagttcacactcgcgaccggagtggaagcttttaagacagcttcagatcccgaaagcggttctattaaagtgttgatccgctcagattaaaagagtgcagaataggacagtggctcttgctagtttcgagcaactgaaatgaagatattttgatcgtcaaatttgtggaaggtgttcctcagtccatgtaagctttaaatctttgcttgtaagtaggcgcaatgctatgatagtaattgtgtattgattgattcgaggccaagaaacccacgatcccttatccgagcggtctttccgtgattaacagttggttcaattgctggatcacggaatgcatggtgggtttatctgtagaaatggtcgattaacctgggtgagaagtgaaggagaggcgcgaacatgggattaacccttccagaaaagggaaattatccgacacatgaagtttggttcccagccatgcctcaacctccagcatataaaatccgagattcttagttcttagatcaaccatggccgactatatcgatatattccacgctcacctgcccagttggctcaggtcgcttagatttccaatcatgattggtgttggatggggtgtggttgaaatttgcatatacgttgttcactaaatttagcctttatgtggtgcaatccaggcccgagttagccgttgaggccaggctctatgtccatacatcatttccggctaatggaaaagcaaggcagcgtccttgattctgctgtaaagactgaacaaatgcagctcagttgctcatggtcaagtttaactggtagagaggcgaagctggcttttaaaggaataagtcagattctcatcacgcttctgtctgtcatttgatcggggaatgtttggccattttcaactagctttcctagaagccgcctggatcaatggatgaagagatgtgtgggtgttcggagcccagctccagtcacatgaacttaagagagttggagcataaagttaaacaacaagagaaaatgccaaacccggcatctcaacacagtgaccagtcacatgaacataacaatgaacttaacatatggctaaattcaagacattttaggaggatttgcttattttaattactcaagggcttgtccttctcacacttctccgtagtatcgctgagtcttttcttcttgttgtacgagagaggccgggcgaggttctcatttggtttgcccacatccacaaaccgcatcgtgttggctaataaggtttatgtaatattggtttgtccccaaattgtggttcccggaaggaaccaagaacaatatacagtcgagtcattatacactagattattgagttatcccaggcacaatagcctgagttctcatgcatgcacatggtttaacgcacattacgatagcttcagtagcctaaaacactaggctttgtggacgataataacatacccaatcggcaagtggtcgccgctggttgtccctgcttcgcctctctgcaacggcaacccaaatcaaattttagctttgggatactaacaatcttgccacagtattacgcagaacccaaaattcagatggcatcccaggattcagatggtaacacttttctcagaagagtgacttggaactcttattaactctcacaaaagcaaggggtgatgactacttaaaccaacaaatattccagtgcttgagcaaatcgccatcaaccccaaatcgtccggaatcttgtcaacacaccttccccgctgaacgaagaacgaaacgtcaaccatcatggctcaaaaacctgcctccgaccctttcgataaaacagaagaggctttagaggcccacagagactatgttgttgaaatccaccaaatcaccctccttagtgagagaggaacgatgcgatacgctttcatgactttcgatgagaccgctcggaatggggagacaggtctagtgttgcacagaaagctcgcaaccggccatcatggaattccataccatgctagtagcagtacctactacatgggtagcagggagggcgtgaattttgtgattcaggaggggttccaagtcggagaaagaggaccacacccatgtcattgcagaagtgcctcaaagcccccggatgcgaccttggttgctaagttccatgcaagccacgaattacaactgttctggagcgtgaaatatttcagcgaagatgagggaaactcaatgttggatgatgctgaatgggcggatggggtgattgatttaataatgaaaaagacttctctggatccttgtcaggctcctgacgaagatgaaccagtacttcttgggctggtctcagaaccgatgtagaattccagcatgaaggagattgtcggttcgatagcagatgaaactagcccagagaaggacttattcaacattggacggtatccttttgcacagactttcaaaagtaatagcttcttagccctacgatcctctttataatgacagtcatgttcttggtccaatcagtgtctagattagtttttaggtgcaactggaaaccccccagaaggcttcaatactcccagctatccacgcaagccagggttcaagttgaatctcggtggatgtaacctcagagggctcggggagttgaccgaaaatcatttcttgacctagccacattagacacaatgaatgagttcctagatgcagcgaacacaagtacgatggtagcgtcaatggtgatcagatcgccctcatagatgtaccacaaggttcatctgtgcgaaggctcggcatatagcaatccctgatgatatcttctgcggaggtagcggaacgaagggggtttcggatttcggttttcgatcggcgttgggcggaagaccagttctatgcaagtgcagcacatgggggaatgccactacttatagtgtagagggctgaatttccgagtgtcagcttgtataatctggtttattgggaaaggatttcttgacggggtggaatgggagacctgagctttgatgggaagttgaggtccagcctttgcatcttgttgcggtattggctgcgtgtcgcaggaatcggcaaccccaggcacggattactcaagtgcgggagtgtcggcacccaaaatgatcaagtaaaaaatatgaaatcttgagagtgggagaaaggtgcgattctagagatgaattctccaaatggcgatattggtcttgtggttttttcgtttttccttatggtttgtgatgggatacaacttaggatacgggcaggaaaatgcagatcgggatctttgggggctcagggacggaaacatgtttactctccgtatgcatagagtaagaatataggggttatgagtattatgaagataccgacagccgccgacagataatctcggttggcggacttataacgttacattcactgttcttttcggaaaatgatacctagatcaatggtactagaatctctgcacataactaccttggtttgtaaggacgaacacaatcccaacatccattgatggatgattacgactctccaacagtgatcaagaagtttacaatagcaaaggttggattttgtgccttttgtctggtctttgcttgtcaaaacataagaaagacgcattctcaagagctgaacttcttagaataacagtccggaaaccaatggaagatacctctcgactctggggcgcgtacctgtacattgaggcttgtcaaccaatgagtcacgccaccatacacacctaaaataactggtgtcaggtcttgctcttgtggccctgaccgcgacccatgtctgtctagttatacgccgtaaatcctgcggtcagcgcgcagcaggtggcttagaagagaccgtgtcgcttctcaaggaagcagtaattgcagcaccccgttccgcatcaaacccgccgtcacactatgaatcttcaagatacctcgcggttgatgggtaaaaagatcaggcgcaacaagcagcacccccaacagagctagatcaattactacgaatgcagggttaatcggcaaccaggccctagagaattaaaaacagcagacaggaaaggcagaaacagtagcctaagaagcgaaagctcttgaatggtaaaagtctataacaaaagaaaacatcagaggagtcatgaggaaggaaatcgtaacaatacatgatatcccattacctcagagaacctggttcatcaagtcactttcagcgatctcgagttccttctctagcatggcatgttgctggttgaccaagttttcggcaagttccggggactgatgatcgattcccctcgcagggcggaaatccaggcccttggctcccattgccatcttcaacatataaaactcagtagggttcctcaggttgaggctccataattcgttcagaacaaacttgaagtggtcagagatctcgaaatagcgggcttgttggatatccaacagtccgtaagcctttcttcggtcctcatcgctcaccatctcaaggcccatggtgaatacaatggagatgaaagacgccaccaaaattccggcttttccagccattgccccgatacaatcaagcgtatctatcgcatattggtgtagacaatcatctggcagagctgggatgtcgcattcaagcgtactccactgttcgtttcgaagctgctgggatattccgattagaatccagaaactgtatggggccagcatattgtaatgcgcctctgacagagcggatagattcatatacgattgaaggattttcgtttgcaaggaagatgccgcgcaaatcaactcgattccttcaattttcttctccgggctgagaattggattgaactgggcgtcaaccgaccaaataatcattctatatgagaggtttagtaagaagaaacgtaaaaatatggatgatagtctacgcacctttgctgtagcacagcccaatgccacaatgctgataagatgtagtccgcgtccttgttcagcaggggggttgggccatatataatcttccccgttggaaattcagtcttgagcctcgcatcgacaaagtcaaaacccgcagggttctgggcccgcgaaatcgagttgacaacgtcaatgagttgggcaaggcgtattagatccttatcaaaggacggcagatcggacatatttgacgtggtacgttcgatgtagtcggaggcatctgtcatccacggcatgcaaggatcgatattcccaaacagcatcatctgcatctcagttagtaaaattgtggagaaatatcttagaactttcgttaatcacctcaatcgcgaccagcataagggcgcaagccagaggcgcgttcgaccatatcaccgaacgactctgcatctgttgacaacaagcagctctctgctttgctgctagttcttggaacgcctctctcctttccaagaacctggggtagtcgtttgttcggcacatgtagatttcgccgatggttgaaaccacctggctgatacccgcatctttctggctcaaggcaatcatctcctcgccctggaggacagaaaactgcatgagggaaccgaaagcttcttcgaagcaggccgtcgtgtacctccagttgtcaaggacaatagccttgcggggggcaaactggaccactctcagcgtgtcctgcttcgggcttccggaggcgtatgagcatttcatcagtcgctcagtgcagtacgagcaagctttgccagcaccaccgtcgcactatagtcaatcagcaccacgaactgcaatctaccgatctgggagagacgtgtggtaggggcaagaaatccacaaaccttcttgtgagctctcctgcaggccatgcagcgatggcctccgcgacgcctgtcgaacttgccgcacaacatgatgttactcgggaaaaatagatgcaggatattagagctccttggacacgcgacgagaaagagggtaatatatgccgagatagagtggcattcatctaaatgccggacccaaaactggagattgtcagatggaagatatataagcgggtacgcgggctcgtgctcctctgacagccaagggagacttcttgccattgtgagttacggccgtttcgaatcctcctgttgtacgcgctagatattcggacgctttggggcgccagtctttttggagcgagccgcttgaccgtctctggcagcattcgcgcgatccctgttctcaggtggagttgctacggcgagagaaccaatcggactcctccagtttgccagggcagatcaggcttagctcgggtcaaactacctgaatcgagttttatacatcagggttgattaccaaataagagcggcaacgcaactgagacaacacgcaggaatcgatatatcgtcacagggccgtatgtctcagccctggctgactcaaaatttcctcttttgctctacgcgtcccgataagctggcgaacagggccttcggtatttgatatctagaggcaaaagggtagtatgacccgagatcaccgacaatgccaccttgatctcaaaataagctacaaactccgcgactccgatgaatttaattaatctggcgtttttgcatagtcgactcttgcatgcttaatgcatttgagatagtcttgcatgggttgaggtctcctcgattcgattgatgccacaccaaagaagggtttagggtagctgcgaatggtcggtggtcgtggttgtgctgacataagcatcgattgcatcatcctgccccggccaatagatctgcaccccgcaggcacatttgccctctttacgcgctcaagcatccgcccggatgagacttgtgcacgcgacagagacgcaacatgtcttcccatgcaagtgacgagcatatggaacacctggaccagcagcaaggagaacaattctacgcactggggacaaaaaacggaggtcacgcgtcaagctcaggggatgccggcccgcggacagcctgcttcaactgccgtgccgtgcgacagaaatgtgatcgtagaattccctggtaggttcttttcttggctgctgctcctcctttccgcatggttgaattacaaagctgataactggggcaagttctcgctgtgtctcacaagcgaggtcgtgtcgatatccgaacacctcccaccgtggccggaaacaaggaagcaccaagtgagcgcccgcattcattgccggggtatgtttgataacagactgacaccaccaaagcaaaccagaaaccgccgagaaactgctggcgcgtatcaaggaaagtgcagttcgtgacgaggttattgccggcctgctgggctcacagtgggctcgctcacaagctcccctctcaccgcgtgtcccatcgccaccgctattggaatctcattctttcaacggaactcacggtctcagcgcgtcaacagcaacagcatcggtcgtctttgagccttctcctgggcagcatagccgctccgatttgaaggattcactcgtctcacctttgcatatcttggcggccgccgttgccgccgacccagaccccacatgccacggccttggctctcgcctgtctacgacgtaccgtagcaagattggacgtaaggacatggttgaccccaaggatgaaagactagctagttattttggtaactcacctaaacctcctccgccttaatttgtgggtgcaatcaactaactattgctgcagccccccaaacgctgcacaaaagagactggcaggtcttggccacacagtccatcgatatgccgttgaagctcgaaccaacaacctgcgaccccattacggcaaacctcattgaccttgatgacgttgcgtactactttaagttgtatgtgtaatcttcatcgaacgaaagaatattggatacggctaaacatgacccctgacgcaggttctatgatgttcgcaacccactcgttggcttgttggatccgggtctccacacccccgagttcgtctatgaagcatcattcaccctattctcggttgtttgcgctcttgggtgtgccatttcatcacggcctcgagatcgtgtcttgtaccctgctctgattaacattgccgaggggaccatgaaatggtccattgccacctctgtcaaaaccgtggaaaccatccaagcgatcatcaacctccaatactgggcacctatacgcgccaggcaatcagatgacccgtattggctctacttaagccatgtaagcctgaactcagtccccatcctgcaacaataatcctcctgacatgctttaatttgataggccacgcaacttgcaagggaaattgggataaacagccccagcactgttgcagaactggtcaatgccgtttcaccaaacgggagccccgagtttcgagagcagttgtcccgcaactttgagagaacatggttgtatacctttatcgccgacaagagcttcggcttgtcgaccgggcgttccccaggcgtacactggagggagttgccagctgctgctcctgagtggtggaggaagccgatgactaccaacttggaccagatggtgagcggtattgcgttggcacgagagcttctggtgagtcttcatcacgactttgcttactttctatactgatgcttctcttagttggaagccttggaacaacgcaaccggatcgaccgaactgcaccggctatcctccattggcacacgcacgccttcgaagctctagagtcctccagaagcagccgatgtacaccaagcgatccgttgtccgctacattccactcggttttggccttttatatggaccacaacctactcgtgctgaacgcgcaagctctgagagacctatcggcgattgacgactcagcaagatctgccgaattctcaactataactcacagaaccgttgctgttgcgaacagagttttggaccttgttttactcgacaagaccttccgcgagatggctctcggattccacaacaaccaattcatcatgatctgtcatgcgtctacagagattatccacgtaagtttttggtttaacaacccgtgtttattcaaactaggcaatatcgagactgacttgaacctctaacaggctgtcaggcgaggatgcctaacatcagccgaagccgcagaagccgcagctcgagttcgagccatcccgctccatctggagaagaccgcacgaaacttccacgcctgctccgtctcacacctctacatattcctctcgcgcttcttcgcctgccagctcgacaagctcctcgaaggcgatacgggggagaacgagctgggccgctccacagatcaggacttcccattcgcggagtggtggggcctgggcgacaacgtctctcttgacacggcggcctggctcgacatgggattccttggctctcaacagccgctctccggggttgatgactcccataccgcggggcctcggctggatgactttatgattaattaggcttggtgttgtagtatacccctgtagcattccttttggtgacactgcattttttcggggacactgcattaattgaaggggaagctgttcttatttttttttccctaagtatttactaatgttgataagatcccagggttgaggtgatgatttcatggcctaggtccactgctctagcttactggagttccggagctctgggcgtgaaccatctattggactttcgggatgatccttgtctttattttttttctttcaaattaattttatcacctgtatcaagtggctgtatcataatacgccaaaatgtttcctcgtagttgcttagtttgatcctcacttttccaaagctttttcttctttaggaaaaatgaagcacggaccctcgaataatgatactcgatacggacgtccgttctgaaaagaagcttaccgcctcggaaggcacttaccgagaaggattcccagcacatccatgacccatgcaagataactcattttccaaatgcgtcaaattcagtgactacctatgtaatgtaacgtaacgtgtacctaaaactctaacgcgcgccaattcttgaaaaccattgcccatgtcgtattctgttcgagtatataatgcagtatgctagagatgcaaaaacgctaagatggatcgaaaagatgccgagctttatctccaacttttttctttcctgaaaatttgaatggccgggcctaggctgccgttgttcccgcaatgttgaggagccatgttgtctatcaacatttgaatcatgctctccttgtccaaatgttggggaggtagagggtagagggtaggtaagtcgaagggcgaagattgacacctggtccgacccctggtagaattgctaccgcagttttccatgaaaagagacctttgacccgtaggggtaaagtattttaacggggatttggtcttcaggaggggcccgtctcccccctgacttaggtctcggatgcatcgacctcccaagacctccagagatcttgcgacagttcacggtgccgttcgtacgtctgagggggcagttttcctgtcttgtaaacttcgttgcggaacgggccatggtcttgataatggcttatattagaaagttgtggcggtgcatgggacaggtgaggcttgacttactttggtcgggaaacggcccattcccgactgtgtatccatgaacccagtaacctcgtggcgtagccccttctttggtgggaatctccctccagcacttgacgcccccgaattcggaccacctgggtcgcgatctttccttgccctggatcgcaacaagctggtagtcgacggctgcgtatctctcccaggggctcagcgatagtgtcacttcagtgcttggcggcacaatcctgcatatcagcgcgtcaaccgttggtaagaatcggtggagcagcctgctggaaagttcttccctgtcctcatatggccatatgagccccgtcatgtcgtcgtgtgcgccatatgtcggcctcgctaatgtgattctcaaaaatgcaagagctgggaagatgggcggccctggctgttgatcgtcccctgttccgggcttccggccatgatcggtcagaaagtccgccaaggccagttggtgcggatcccactcgaagtgaagcgacaccatgtccgataacctgggagtcgggattaagttgtggaggctgtgcataagcgttgctgatttgatgtatatcgtgttggtgccgaataatatgtgcgtgccctcgttataactagtaagagattgaccttggttagacattcacggggcagtctagtgggagtaaggagaggctctatgaactcacgctttcctgcacgtcagaagccatcccaagatgcctatctggcacttcttgcccggcacctttcccggccaggcgtagcagtttgcacaccccatgagacagtagtccatgtctgcgtcagagtactgctcccacgggtagtggcaccatctcccaaacgggaggggaatcgctttcggcgagttgcgatggcagatgcacccaaaccacctccattcctcctcctgggatgtgtcgtaccggctgccctgggcagggttttctgcgtgtatcctggcatgagaactcgtgtgcttacaatgaccgtcacgaaggataagggggtatcggtagctgaggtccatgtggactgtccgctccccaaaggcgatgacctggatcatccggcggatctcccagggaagctgcgtgaagaagaggttggccttggggtccgcgcactccccgggcgtgctggcagttgaagacgcccgcgagaccggccgccgtttcctgtgctgcctcctgcgcttacgcaccatgttctggctggtgttgtagcgacgcttgaggctgcagcgcgcggcgcgccaagcgacttcggtcagggttgcggcctgcttgagcttctccatggcgcggttgggaatgtggcttatgatggcggtgcaggccatctctggtcagctcgcagtgaatgaggccggcgagagtgtctgtcctgggggcatctccgtggcgtgacgtggccggtcattccatctcaggcggcggtcgctggtgaagcgtgtctgtctgccaagaaggggggagacaaaggagcggtcttagtggcggatcgcgacgtggacaggcacaatggatgggtgagtgctcattgacgggtgaagcgacgttgaatgtgatgtggctgaatgaatattgccccgctgacaattgaacagctcagccatgaactgacacatgctggaattcacagagcacgtgcctggatcccaccacggccgtctgctaattaaaggctccagccattattgggtgctgactcgctgtgcctcgactcggccttgcgagccctggactttgccactattctaactgagacgccagggagtcttcaagcttaccaagaatccgtgaacatggttaaattcaacctttttacgggggatttatccttcgatcgccacaacacgctactgacggtgtgccgagagaactgactcatgcttgcctgattggtctcggcattctccatctgtactgcaattgggcctcaattcttttccatctacatgtcaagggatatatatattcatttgtgactttgagtacctggtcgtatcggcttaatcgataatctccatgtttgctcgaggcggtctgatttaaaacgatggtttttgaggctcgcgaatcagaaaataagggtaaaatgacattaaatcggtccaagagaccgggaaatcggacactcatctctcgttggcggcgacataacctgttgaccgatgcctttctccttcggtatccggagcaccaagctcaacacggtgcgataccaagggttcgacaaagaaaccaccctcctgccgcagcgacctcacctgagtttatttttattgagcgatgtgagttgggccacgggacattgtattcgtacccgcgggctccggatcgtatcggacctgggcacctccattctctaggagtccaggatgcatcgtctcgggactcccgggcgggtgccaaggccgagaaaccctgttcccgttatgggatttgattttatgatttatcacggactccacaagtatcgagagtcgagtgtttcgagcaggtcggcgaattccagtggccaatctgcataactcttcatttctgtcggtagcgccgaggcgacttgtcgagtccatgagatgatgacatttttgcgcccaggcgtgctgggaccctcggtcggtgcaatacaaacctgcccgaggacgtattcgaccaagaatgtatgaattattagtagcctagccacgtggttgtcaggactgacaaaggcggaaaagtcgtcatgtgagaacgatatcgccatcatgaaaacgtcaagaaagcgcttccaggctggcaaaaggttaatttcgtgtctggcacacagcttgcggaggaacttgccttcaataccagatatttccaccgcgtcgacgcagcgaacaagcgcgtcggcataatttccttcattctcatttgcggccagtggccgcagtgcgagagcagaggatctgaagccatcaatggtgctctggttctttggctgttcttggaccatcgagctcagtatttcaaaatgctcctcttgatgggcacggaaaagcgaagtggctatttctttgataagtgagttggcaataaggctcccacctctcgacatagtgaggtagtcggccatactatcaaggtcaggcaggaggcttgattgcgacaccaaacagagaacagccgctagtagagcatctgcctcctgcgacgatagcgagggtagactgaggcgttcattgacccgctgcatggtagtgacgcgatgctggagagcctctgttgtgtaatccagtcctggtgtgctctgggtaatatgggcggctcccaggccgagtacagcatgcgcaagaaaatcatactacaaaccgcgtgaacatatgacctagagctagatactgagcgatgcatgcttctcacctcatgtgacattgccgcgcactgcatccagagatcttctgatttgagaggaatcgtgggacgagcaacggttagaaactgatggtagaacctcagatcttggagcgtgaggctcgccaaaggcgcctggatggctgatgaggatgccatcgacaatgccctggtggcatggcttatgcccgcgacagtagatggatactcgcatcgtaaatccagacgacgacatccgctgcagacgggatgtacctcatcgcacttcacgcgacggcgcttgcagctgtggcagcccagacgcgacttgaaatgtccgcggcgatgggagacctgccgccttgaaggcccgcgatgggtttctggggcatcctcgcccctattgaggggaggtcgtgcgctggaattgcctgtcgtttcgtcgagatgcattctggagctgacgtggcggggtttcaattcgcgacgcgttccttcaaggttgcgtcgcatttacgtagtgtaatggaacctaaggctcactgcttcagcccaacttagctcattcaaatatggcagtataaaatgaaataaatcaaaaatcttaagcttatcatcgtttctttattactagccctaaataatccgataatgaaggttgaagtcccaaaaataagcagcataatattcgagtgtcttaaatttaatgtcaccccctttggatgaatctttggggctcagcagaaaagctggactacttgtcagcaaaacaaatgctctgagattcaatcatttgtagttcataagtagatattgaaggccaaaccgcgatgacaaacttgctcactctatgtgttccgacaaaacttttctaggctataactaggggtaactgatcaagctaacagagctcaatgggagcatcaactcggtatattaacataaaaggagcctagtgccaatctatgctaattcccagatgcagtttttatggtcttggagagatcgtgaagttttcgcaagtaggtaggagccagacctgagctccggttggataagcttcatccgaagtgatatggtatttccaatgacgaagcccggggttagggctcgtcggagtcctgatagaaagcttggaccatgaattcatatatggggtcggcaagttttcacgtttcactttggcccattgtagaagctcatcgcaatccttgctgtccaagcttacccgtaggatcgccgagttggaaataaagcgtgaaattacgatccgcaacggtaaaacgtgtcttgatacgcactccaagtagagaaggtggaatcatggccgataggtacttcagtagggagtcgtacgtttgcgcaacatataaaacccatgcccgtcaaattcccacccgatgctagaaggaagcctctatgtatacctagacatcagcagcacccctttagctcacatgttgattttatgccttctgatcggcgcggccctggccatgccaagcacttggtgtggtaataaagcgccaacctctgagcaccgagagacaattcaagcgttgcgcgttgcagaatccgccggcatttctcttcatcctcgccagagtggaaactctacttccacgataaatgtccccgtatacatcaccgcagttgtcaacacgacagacccggaggagatgctgagcgaaacagtactgaagtcgcagtttgacgtactctccgaccgctttgctccatacaacatctcctttacgctgaagagcacgaaccgcatgattgatgacaacaactccaagggctttgactacaacggctggaactccttcaaggctgcacagcgcaaaggcgactatggaaccctcaatctgttctatgtgactaacatggacgatcagacatgggggagtggttcctgcaccctaccaggcgatgcatctggggggcctctggtgactatgcttgatggatgtacaatgaatgcctataccgtcccgggcggcctgtctggcggaaagacctataaaggagaaattacggtccacgaagtcgggcactggttttctctgcttcacacctttgacggggatgactgcactggtcctggagtaagtgaggctagcttcggtgacagagtaggaagtggccagaactaatcactggctaggattatattgatgacactcctcaagaggctgtctgggaactgaatgtgtgcccagtcggccgggattcgtgtcctgatcagccaggactggacccaattacaaactacatggattactctggtgtaagtcttcttccttctactatactctcaaacgcactttgcgcctcgtaagttgcgtaaaaagtgcgaaaaaagatcttttagagaagaattcaactgaccgtcttttaggaaggatggtaagtttcaagctcacaaaatcggtaaacagccttcgctcactagtgacacagctggacagaatttaccctaggccagacggaaaggatgcataacgcatattggacattgcgagctccctcgtccgtctcgaagagaggattggtataatttctgtactttgggaggtcatggaatttatctatcagcggacgaatggcgagaggagcaccgcacgatgactgaccctaccagttgatttgttcactttgttgaaaaccaaacggacgccatcctgctcccaacaatatagaaggtagaaacgttcgagatataagccaagtacagatattcttaaacgacccaggataaatggaaaaatattatgacgctggtggtgcttgtttagggtaggtaggctctgggaatggaatgatgaggtaacactttgattaagacaggactccaccttttattggccaattaaaatcgctggaccaatctaaccgtccttaccttatcttggaccaggacgtgcattcaattcattcagtttccagcacctcaagttgcgccgtgacaaagctccttcggttctttgataatggccacccatggctactgcttccaatctggggactgcaactagattcagacgtatcacgcgcgcttgtgacttttgtcaccgacgtggtctcaaatgtcgcgctgcagctgagagcatagccattggtggaactcaaccctgtctgacctgtgctgaggtttgcctgccctctccgtcaagtctccgtgaatcctgctcactgtttcaaacgacagtacagacaagaatgtacatggaatagacagccgaagaagcgaggcaccaagtcccgaatcgctactcaggcgcagcaacaagatgatgcctccgtccgcgctgggaacggtccctttaaggtccttgatccctctgcagtaagcgtcgctgccaattcatcaattggaagccgaaagatcatcactgccctgttggacgcctaccttgacagcatccaccccatgtacgtcccatcgcaataatgaatgccatgtccatatatagtgacactttgcaccatagattcccattcttctgcgagcgcgagatatgggttggctggagagatggcacgtttcccgcagacgcctctgattacatgagtctcatgtgtatgtgcgctctcagcgcccagcacgtcggaagtggtgcccttttcagcgacgatgtcccgaccgtcgagagctctcttctcgcccaggactaccttgctgaggccgttcggctcgtcccgctggatttcaaaggcccatgcatcaaccaaatccgctcctatggatatctgtcgcttcttggagcctagacggggaattacggcatggcgcacaagtacctcggcctctaccatgggatgtgcgcgcactacaacctgcacgacgagtcacaatggccagcaggtcttagcgaatgcgagattgaggtccggaggcgtctctggtggatcatgtaccgtctcgaggtgcacaccgcatgcgttcatggaagcgtcgtgcgctgctccgaagctcagtgcttcgttggctacccatctggccttcaccaccctccattcattccggggcgggatggcaaatatgaagactggttcaggggatggaatgcgaccactgatctctatcgtgtcttggaacatgttattaccgatttcagatcgcgtcgaagacctcaatcatccattctcggagcaagccacgcgaaagcgcccgcagtgtccgtgaatgagaagctgacgaaaattcaagaggaaattctacctcattttgggtctgtctcatcacgatcctcagatagcggcagaaacagatgcggatttcaggcgtccaatattctctgcacgatccacttggcgagaatgatatcaatatcgggagagagcaatttccattcggcatgccagactgcacacgacatggtagcaagcgtgagcacaatcccgattgagtacatccgagctattggatctcccctcttgcagcagttagcgggcgtgggccacatgctggcgggcgtcgcgagcaaacaccagttctcacacgcagatcgagaacagtttagactggtcctcacatcaatgatacagtttctctcgcagctgaaagcacacaacagcaccgcggcaacggaggaattgagactgacagcccacctgagcgaggcagacaggaattggtcattggctaatgccgggactcaggtattggatgacggcgctacctacgataatcttgcgtggccggatcacctgcagaacttggtggaagaaatgagtgacgatcgacttttcttctctatgcacctggaaagaagcctcgcatggccattcgagccgcgagatgaagacgggccagaaccttaaaaacatttcaaataaaatctcattccactacactcttatgactttactccgattttatcattacaagtattcgtgtttttctgcttgtttgtccgccaagcgtagtactcccctcctgtcatgatcggatacttcatcgggttttcctcactcacacaagttggaacaggctcaagcagcttcttccggtcgaatccgaaaaagaaaggtgcagagtacctttcatgcccgctcttattaatgacccggtggatggtagagacgaagaagttgttggtctgtctcatgaaggcatccgcgatgttgaccacaaaggatccctcgatcggctccgccttgatccagttaccggatttgctcagcacctccagacctccagacaggtcttgggtgacaatggtgaaacactcgacgtccgtgtgggcaccgatcccgttctgttcatcgaccgagtgcttttgctctgggtagtggagtattctcatcccagcttcgggacgtcggacatattcgtcaaaatactcttctgggaggtgaagggcgagggcaaagatcctagtcaggcggcgcgagagctcgagcagcttggtgtgatatgcgtagagaccttcacggaagcccggtaggttagatggccagatgctcaccgaaggctctgtcttatcgactgcctcgggatcttccgaagcatcgtaggcccagttaaacgcctcgctaagatctatattggacattagatgcggttttcatggaaacaatgcaagttatggatgagattgaaggtcaagacttgccttggtgtttccagccatttcggttatagcactccatcgggtggaagccgacatactcattgggtactagaccggtgaacacctccatcttcttctcctcgggtaaggcgaagaatcttttggcttgatcgataacctcagtggcatagtcttggtcgataccctatcgggttgctctgttagcttggattgtggcgcaaagaacaaggaactcacatgattgatgaggtagaaaaaaccaatattccgtgacgcatcccggatctcttcagccacagcctttctatcttccagcttgtcactccaaatgcgtgaagcgtcgattactggaatcttttccagctccgtggaaatgttcgagttgaagctgaaaacatcaccattctgcagcttcactgtccggactttggtgtcagccctcgtatcaacggtagtctgagacatcttgtggagtttggcgaggttgtattggctgtttgtaagaaggtctttcttatcaggaatcgttgatctagtttggatactagctatagaggatacgtacggagtaggagtatttatcaacctacactccgggtatcagatacataaccacaagtggaatgtcttatcgataaaccggcagaactggtaatcttagaatcacttcgtatatcgtttcatgattcgctgggcaagagatgtgtggatggcttaggacccttgataagagagcgtggcttatcataactgtgactaaaaactgataaactgaactgctaaactgctaaactgctcattctagcgtaaccccgcaattcactgccaaatcagcacacgcggaattggtttgtaacatgcatatcatcgattcaaggttctatctggggttgcttatctgaattgggtccagtacacccagattgccggttcttatcacttcaaagacttggtacgctaggctggcaactccagattggcatcccgcctccatgtcaagtctcttgatccgtttctccaacgccggagaggcataaaatcagatgactgcactctctgaaaatggattgaccatctgattttcatcattctgctctgacaatattacaatagtcaccatgacggaggcttcgacatcaaccttcaccagccgtttgcttcggcgactggaagtccagagggacacggatgctgatgtggatatctacgttaacaaggacactcgtccattgcctccgtcccgtcgaccttatggaccatgggagtttgtcggtctctggatggtcaccggatccttcaacgttggtggatggacgactggctcttcgctcatttctctggggctgaatgtctgggtatgtatggtgcaattggcaaccgttgggatcttggtataccgtatctaacacaagatatagcaatccatgcttgctattattattgcgcacacctttgtcggatttgtatgcattgcgggcggtcaccctggtgcgaagtggcacattggctttcccttgtggatgaagcagaactggggaatttggggatattggttcccaatggtaaatccggctagcgatttctctccacagaagaagtgtactgacaatatgctactccattagattatccgcgtcttcctttcatttgtttggacagccaccaatacatggtatggtagccaatgcctcaaggttcttcttagctgcatgtcgccagcattccttaaacttgacaccccattggcaaacggagccatgaaagcgtatgacttcgtcgcattcatcgtctacttcattctgtgcctcccgttgatctggttcagccccgagagatacaagaaaccattccttgtctcatcagtgaccgtcgcgacgactgtcttcgcgctgctgatctgggcgaccgttcgcgctgatggcggaggagctctgctggcagacactaccatcagtggcgtcaaaccggccaaaggcggtgatctgggctgggcgtttgttgctgccatcactgctaacataggaggcattgccacacatatgtggtctcagtccgactacacacgatatgctcgcaaaccaggtgaccagatcctggctcagcttgtcatggttcctcttggcactatcatcgtggcatgcattggtatcgtgtgcacctcgtgcgcggcgactctttaccccgaggagaagaagctgctctggcaaccgtatgccttccttgatgccattcgaaagtacgaaggtaatagtggtgctagggctggtgtcgcgttcgccagcattgcattcatgttctcccaattcggcatggtggtcgcatccaactgcgtcgtcgcaggtattgatctggcagctcttttccctcgatggttcactattcgacgagggggttacttcacaattgtcttcgtatttgtcatgcagccgtggtcgttgttgaacagcgccaccaacttcctgactgtcgttggaagcttcaacatcttcttgggccccctcatgggcatcatgttcgccgactacttcctcctgcgcaagaccaccatcaagcttacagagctcttctcgacctcaccggagagcatttactggtataccaaaggctggaattggcgcgctgccgtagcctggcctatgggtgtttggttccttatgcctggcctcgcccagcgtgccgtggaccctactgggttctgggcagggtggactagactttatcaactatcatggttcctgggatgtttggtttcgggtattgtttacatggctctggattatttctggcccatgcccgagaagcttgctgtggatgatcttgactattttggaacctttggagatcctccttcatttttagaagccaaatcaccagtcccaggcgctatcattgaagagaaagtattggaggagaagggagacagggtgtaatgtgctttgcggaagaattgctcacaacttgttgattccgggtttgatctttggtaggatagattcaaatatatcagactcagtgattcataatgcggcaacaggacgtctaagcagttgaattactgcggttcattggatcatctggaccaaggtgacaaatccaaatatcagaacaagtaacccaaagtatactggttgtgcaaaggcggtcaagctgttggattaggatcgcctttgtacagccagtatactttgggctgcttctgttgaccttcggatttgtcacctttcaaagctttttagcctttcgtattcattgtattgggatgttgggtctggcatctttattgctgcttcttacttagtaatcggaccctctcatccgtgattcattggataatccggtcttcaatttgtttcggacgacgttgaaaattggatttgagcatctatgctgatcttcttttggctccccaatgttgctcatgactctcacccgcaaagaaatgtctatccatctctcccggccatgatactatttttgtgagtatttaaaccaacaagatcgataacctgaattcagcacttaatacaagtagagcccagataccattcaaggttgtatccaaggtgattatgaactggcaaaccatttctgtatgtttccggcatgaaactaccccagcacaagctagaggtagacatcacaacaccccacatttcaacagctaagtcgccacccatgtcaacggtccacccccctcaacggtccaccttcaacgattgaagtatacaattcaaatacgtatttctcagcgcaattaattttttgtattaaaaatgaagctactcaagttgccaggtaaagtatagctctttaaaaatataagtcttaatttcctgagctgatatctcagtatctaattaacccttataccgttcccttgtattaataatattagatatcttgataaagcgtttattcggatccggatgaacagtatatcttttcttcggctgcaggaggttatttaactccttaagctgtatattttcagtatttgagatagataactgtatttgctgtttatccagacccttgcagatcttacggaacagcagtcggatagttaggtctacctccttcttatctataaaatcgtatattaagctatatagctgttaactccctgttggagtagttattacagcttctttcctctttaatccggctgctagtattaccggaggtattaagggctggtttttaaaggtatattaaggtgtaagtatataagggtttattaatagcactgtaatattcattagctaaagtccggatactttccagcctgataggatatttttaactgttaaggtagctagccgggctaggtgataatactttaagaaggttatcttgctgattagtaataaatctgtctgtatttattattctgagagatagtaataaaatactcgcttaagagcagaaaagatagataagttaagcggctgtaaaacgtataataagtataagggtaggaaaagaagccagatcttattttggaagtattcctatataaatttaatagtcttataactcttatagctatctataataagtaaataccagctgttatttataggtttagttaataggataaaaaccttcctgagctatactaatataatagtattagaagtctaccccttcttggaagctataaaatactactgcttgagataatctagtttattaggaaactactgctgctaaatagtctttcctttgaagataataagaggcttgaggtacctgcctgttgtactgatatacttaataattatagtctaataacgagttcccggctgtatcttagctgcccagttcttataagataatctgagaaccaggctattattactaattccttctataatactggctttatctatattctaataattataagaagggatcttcttaatattaggaatatacttaagcgcaaagaaatcctttattcagttaactgtagccctatcaactcgtaggaagttaattctcttgccttgaagagttctaacctccgggttacagtataaaaatccctctatctaatatcttctaatagggttaagattaccctgttcgtacagcaggaactcagcaatatccttaacctttgtatagatcggaggaaacccaattgaatcttaaataaggatctattttattaaacaggcttcttagaccttcgagagctgctgctgggtctctgcttcctgttgctgcattttacgaccttctatacgcatgtatagggttatccgagagattccccatcgggctgcagcttttcgctgtgaagcatctgcttgcacctcgtgaatagctgattgaatattatcttcggaaacgtcaggtattggcgaatccaatggtataatttttaattgaattgaataaattttgcatgagaaatcgcgcagttatacatacagaaaatagggaggttgggacttggaaggtggaccgttgagggggtggaccgttgacatgggtggcgacttatttcagcaactaacagaacctcaatagtcagcctaggaatcacaagacctcatgctgacatgcagccttcaatagcatcaagacccctgtcctctagcgtgttcagctgactggggccggaagcttcgttttaccgatgcgagagtaggacaaccaacattgatcccaaagttccaagccacaaaaatcgaatgtgagagttcaaaacctctaggcctctaaaatgcaagatgagatgggcccatttttgtattctccagtcgacacaacggatggcgagatccgtcttctcactctgcaccctgcctcggacaaagaggcccttattgtctgtgacctcgagcgcgtcaagttgcgtgataatccgcagtttgaggctatatcatacacttggggagatgagcacccgtccgtccagatcgtcttaaatgatgccgcattcaaggtccgagaaaatgcagcggcggcacttcgccgcttgcgacggcgcaaaggctctcgccgcgtgtggatcgatgccatctgcatcaaccagggggaggtcccggagcgcgaccggcaaatcacggtgatgcagcacatctttgggcaggcctcgcaggtcatcatatggctaggagagcctacggagcagggcatcctcgggataagatacctgcaggggaagctcataaatgccagtctccgccagttgtggcttgaggtacacggtgacaatgtcaggccatcctatacaacaaacatggctaccgcgttagataggctgacgtacacggatgaccaactggtcggcgaaatcagagaactcctggatcgaccatggtggaggcggacatgggttgtgcaagaagccgtccttgcccagaagcttgttgtcatgtgtggagaggaactagtgagttgggatatgataaagaagctcattgaagggcggcgcataagtcgaccgaacttcgaggctatggggattgtgcttgatgagactactttcccggatgggttatttcgcttcatttcggagtatcgacaaaagtggcatgattccgcctcgggaatcaacctccttgagatattgtatcgatgccgagcgcttgaatgctccgagccgcaagataagatctttggattcttgggaatcgcgccatctacccaagcgatgggtgttgttcctgacagcacagcctccgtctctgatgtgtaccgagagtttgcgttcaagttcattcgaggaagccaatcattggatactctcaactacgctagggagtggcaaggggcaccagagagatattcaaaagagcatgtgtattctctgctcgagcaatcgaagtatcatgatgtgaaggcacacatcgacgacggcccaggaaagaagccgaggcagtcatgggttagactccctgatggatgggaaagaatacctgggaaggttccaaaattccacaactacaagacaaatgagacgtttgaaaagagtcccttggccggatcattatcccgggctgcaatgataatggaacggcgagagctgccgacaaattggcaaaagaaatgggacaatttgggacgggccacagtatcgcacgaaccagaaggagagagacccgccgtgaaaccagaagagaagataacaaaactactggccgacttagcccagcttccctcatgggttcctaactggtatactccaaccgcctgggatccagaacccctcttggacttcaccttcagtcatccgctctattgggcatcgggtgatgagatgccgcatgtttctgtgggacaatcggcatgcgagttatcattgagtgggttcgtctttgatgaaatcgagtctattgcgccggcgtggcatccgcaaagtgaaatacctgccctttccaggaaaggaaacgaagctttgattgcgtgggaagaacacgctttgcaaccggtacaagattgtccgtacaaagactctacccgcgaagacgctctgtggcgcacaatgattgccgactgggcgggtgctcacgccgcgccggagagtgataagcactacattgaagtgtggtatgatcgcaatggctgggcgagagaggtacctgatatcacaaatatgggattttgggagggagctatggaagaagtcacactcacccttcacgagcaggacatgcttaatgaattcgaaagcttgcgtctccgcgatgacactgaatatccctcgaacaaattttccagctttctccggagtggtgaggaaaatttaatcgtaaagcactatggggcctacgtgaaacgtatccagagggcttgtgcccatcgggcgctctttgtgacgaggaagggatatattgggctggcgccatggaatgcaaaagaaggtgatgtagtggcagtgttggatggagggaaaacaccatatattttgcgacctatttccgtggatcagttcaagctagttggagagtcttttatgtacggaattatggctggagaagcattgcaacatcggaaagtcctagagaaaccagaaagccggattcaaattgtataaaaatcttttcagtttgcggtttttctcgttggaattgtgcaatatacatacaggttctgagcaccaaactatctagactaccaaaactgatggccaaagagatggataccacatgatgagtttaactagatatgaagaggaatgctatcgctacttgttgaagaatattaggttcgcctatcataacttgtgaagtcaatttaaaatactgcctgggctgtctgatgaacatcacgcagctggcaatgacatccggaatagtaaaaggatgctgcctcagcgtgtagcatcaaggtcctccagtggaatatcttgctcacgagctatccactcatcatatctaagaggaggtttagtgccgccttggaagaaaagatatcgtttaacaaaatatggaagtatctcggatagctgatacttggcgaacttgctcttcggttgattatagacctcgtccaattcctcgagactaaacattcgagtctcctcaacgatgaagaaaacgaggatgagcgcaacaaaattcattccagcgaagaatccgagcaagccgggtgttttaaatgcctgcttcatcgcggggatgatgatcgtgagaattccggcaaagaatagattagttgctattgctgctgatgcgccggcctctctatgagaaagagggaaactgaatagttgtcgagtcagttatatggtagagacaatgcgagcggctttgactaacctttcagatgccaaggtgaatggtataggacctgtagtggaccttgggttaaaatagacctcttaagggtttgaaatttgcatacctaatccaggagaatacacagcaacaaaaactgttatccgtaagtttaatcgaggaacataaaatatcttagggaagtctcacttaatatcaatgatattcctgcagccacacgcgtcgaaaccacagtgctatcatcaagtgggaaggctccggcagctccggctagaagtatacccatgattggtaaagtggcaagcaaccatgttctccgaccaaaagtatctattgtacgcattgccggaaggcagaacaagaagtttattgctcctgtgtagccacacgatgttagagaaagtgcttgaggttggggggccacggcaagacataccaaagccaaagctatagagcatgggcttatcgatcgtcgagcctgtcccattgaaaaccacatctagttatcaagtcaatttctgaagttcttctgagaacggaagtcttactggagtaaaaggcaaatacgttgactaatttagagttagaagttgtgaaatacgttcgcttaggggctgctgatacacctacttccgcaaagctgttgagccaatgcaacagtcgacgtactccaaacagcatttcttagcctccgtgtcttgaaaagtgtgcggtattgattcaatgataaacggaggactactcggagctgggaggcgtatgtcagcccttgttctgggctacaagattcaccggccggtccgttggactcagataatctcttcaacttttccgaccagcgtatgagaattatatctctcaaggcttgaagctactgatatgttagtttgacgtcttccattaatggcgtccaacataatggaagctttctcactttggactttctgattcttaacaagattttcagagcctggtttggatcaaagttcggcgactcttctctcatataaaatcgtgaactttcgtagcagaaatacactgagatgagaagagccacacttgcgaccaaaggagcgccgaggatgagttgaagggccagccagtggttgctgtcgctcgtttcaatatcgttctgcttgagaaagaggacgttcgtggcttttgcgatcactaagttggccacgaagcctatcatgataccacaggcgaccctgtgagtggacaaaggttagcgctctcggtgttgctaaatcagaggcacgaaatcatctcgaaacgaaccacaactgccaggttatcaatatcgatcccctccaataccccgtcgcagtttccgcagctaggataggcgcgctgacggctttaatccccatgcctaacgacttcggttaatgtggaatttcacccaagtagacatacatgtaagaattcaagagaaggagaatgctagcttacctactcctccaattattctgacaccaagaagctgaatccagtcctgacaaaaggccgacgatacagagctcgcaatgattagcaaggcagatacaatcagcgcgccgcgtctgccaatgtagtagtttgttggaagtgatattggggccccaataatggcagcagccaggaaagggctggcattcattcccccaatttcccaatctttcttccgagttccaatctcattttgagcgctgccagcgtctagcttcaggagcgattcaaaaagcgacccggcgttgatggacgattgaacatgtccttgaagaaaggccgccagagcaaccgtaaggatgacggggaggattccagattggaagaacacttgctcccgctcggctttcaaactgtccaactcttcctgcgtgaagcgacctagtgggggaggtcgggtacctaatttggcaagaatgatcgctttgtcccattcttcctgattgatcccggagctttgcgagttaggaaacagctgcttcatgtcatctcgaatgtccggattcgatacaccacctgggaaatagtcaacctgacagtggtcaatgaaatggaaaaagaagaccttgttgcttacgtagggggtcggcgatgtcaattctgtccagattcgtgcgatttgccgtaaacgagcgtgctaaatctccgaaagtctttctttgatgcggagtattttctgaactctggtcctccatgtttgttgctctacctactgtttgctgtataggctgaatgggttggtcgggatgtatcgcgtgatgcagcagtgaaggcctcacacgacttaggtgcttgacctgcagcttaagatgtatatataagtatatactctaggcttccataatattggctaatggaaacaccacctcggggggcacttgtcagccgcacgcctcaattatatggttacacccaggcaactgcccgcctgcatcatcccacacctcccttgccgtcactactgggtgtgactcgctaccgtcttctaggacgcatgaaagtgtaattacacatcgactattctcctgtcatcaagtcatcatgtggcgttcaataattccatcagctgaaacgaaccttatctgcagagccttgtctcataccgccaggggcaaggtctcactggtggtcttagatatttccccaggaaccacacaccagccagcccggacacttaccccgcgggggcccaatgtactcgatccacgtattaaatgattcgatgagcccgtgaatgcctagggtctcgtgtagttggtctcccgatattggttgggggggggttgagaaccacaatcttcgagcgtaaaggggcgtaggctcaatttcccaaagcctggatttagtaactcgccgatgctgtgttctggtactatgtgtgaccgcccaatttgagtttccgaaagttctcttatgattactggcagctcctccagccgcccacttgcgtctaacccctgtccaaacctccacaagctgaatgcgagccttacggagaagtgttctcattgggtccgaacactttcggccatcagcacgcctcactacgacgctggtttattgaggtctagtgacccctcttctgttattattacacaaaagtgcgcttgcttaggctgagccacgcgtagtatgacgctgtcgtcaccaaccctccctgaggccatgtgctaccaacccctcctcgataactctcatctggctacctctaagtcaatctgctggaagttctttccgttcctctcctattaataattagtgccctactccacattacacgtggggaaagcacttccttccttcatccacccacatctcacttcctctattcgtgcagtgagtctgttcgaagccctttgccaagtactcgcaacctttttcaagcagatgtccatattgaatgtatgcccactcaatcacccaatcatactgagtcatagggtgcaatccggaagcctggcacaaggctgtgaagcaatgtcgggcattggcgaactcgccaatgcgatacagatcatcactggtgcggttaacactattcgactggtatacaaggcctacgaggctatcaaggacgtcgatcaacaaataaaacatctgatatcggtctgcggtctggtagagaaaaacttgagtgagaccctgagtctgctccgccagcgacaaaaatctccaaatcaagatgaaagacgaatggagtactacagctcaattgcccgagtcgtaagaacagtagaaaatgatcttgaggatgtaagaaggagtatcccacacccagacaaattgccaaagcccaaaatgcttgcaagagtattccgttcaagaccctacaaggctacggacctcgccctgaatttgaacaagaatgcaatgaagcgaatcgaaactgcgtctctccatttacaaatggcaacttccaatctgtaggctgaatccctccctcgtcacgctccttcctgtctgtagggttgcctactaaccgtaagatccaggtggcggtatgagagcgaaagccctggtgctgtcgaccaggattacttcaacgggcttcgaaatctaagccaaaagtttagtagccgtgcatcgactttcagttcagatttcgaggtcatgacgcctagcttggatggttccgatccaaattccaaggaaagagcagaggaatatctgagagatatccggcaatttaacgactcagcatttaaaatgttcaacgacgttattattcgaaccttgcattcggggagccagacccccgttgacggctgggaactatctcccgtcagcgagcagcccgcccttctcgaaccccctccgccagaaacctacgtcagtctagaagagctggaactcaggttcagcgaggccaaaaaaatggcagagctagccttaaaccatgagttcccagatgcagcggcagactaccatgctgaagccattaagtgctacgccgaactctccaaggctggtgagcctagtgtttccgtcaagacaaagctcgagtcggatcacgttggtattttgatcaaatgtcatcaaactggtcgacgtgagaaggggatagagcgcttaaatgaacttgcagaggaggcaaagagattagaagctgctgatccgcccgaacttgacgcttctgaccttcaccggctgcgccgagatatcggtgacctttatttcaaattacagatgtgggcccatgcggaacacttccttcgtcttgcaatctttgagccagaattttcgcaaaattatccaagcaataaagaagaggcaaaatctattgcttggggcatcattcaggcatacaagcacagctcgcgtcttatcgaggtgggggctttcagagaaatgcttgttcgccatttgaaagacgacccgacagtagagccccaagaataccgtgatactattgcttggtgtcggaagaacaacttcgaggttgatgaaatgagcacgccaccttgcttgaacaagaaagacgcagatggtgattttcctctccataaagctgtctgtgatccagatgtcagcccagaggtgttgaggcaactggcatctgataggaatgcgatcaatgccagagggaagaatcagatgaccccattattgatggcagtagaaaaggggcggctttcagctgtacaagtgctacttgaagaaggtgccaacctcgacctcaaaacgcccgacacagacatggtcgaaaatgtgcttcacatctgtaaggatgtacagattatgaggcttcttcttgagaaaatccaatcgcgacggcccagtgtggcaccatcgataatcccgcaacagagtgagggtatagaagacccccagcgcatcgatatcaactcacagaacccgtatattgggacagcacttcatcatgcatgcgtaagagatgactggccgattgtggaggtccttcttgcctatggtgctgatccaaacgtcgagaactccatcggcgagactccactaatagtgacatgtttcaacacaggaacacgaatctcaactaagcgaattgtgagagcactactgaaccacggcgcctacgtcgatcagggagattattttaaaagacaagctcaaaaaggtcttaagcagagaaattttagtgcatcagatattcatagtcttttacaacccacgggcttaagaagcggcagctcgagtcttcgaagggggactgaaacggattcaatggcatctgcgaggcattattctatcgactccctcggcttgttatctgaagtttctcgtgatggaagtagtacctagatagtgatattctcattattaacacgtcaaaaaacaacacccaaaaataaaaatacaaaatccgcaaatcatcacttcttggttcatttgggggaggtgactccgaagttggtaagccggacatggcagtccaaaactccaagccctgttcagtcctcagctctcgcccatattattcaaaagatagaaaattataagaaactactgagattaagaaattaacaaaatcgtattccgtcgattcctcactcacccatacctaaacggtaagcaatattcattaaagtacatacttcatgacacttctctctcccgccatccaatgctcgacagctttcccattcatgtatctagtaatgtaaacatcgcccacaagtcgataagacgacctagtcaccaggctacataaatcctgagcccattccaatccggccatgttcggtaatacacaagcttcgtcccatcatcttatcaccgagtcctttttgcaagtattctcttctatgcttcgattcaatatcaacgggagcatcgaaatatttcatcaaagtcggatccaaagaaaggtatggtagccgttcatgcagaaggttggcaaaaacactgtagcatacgggaaaccactgcgaaggcgtattatttaggtggaatctgttccaagcatattgccatcgcgaaatcctcctccgcccctcggatagcggttattcgcacatggcccctcccccaaacaacaacaattggtcatcactacacaagtttcaacgtcccatgcccaaggttctcgtttgtgacaatagcccgaatatgcgcatggccccatcaacataatcggccctccctaatcacccgagcgagggggatgcaggttcaatttacccatgtggcatgttcaagcacacatgacagacgagcggtccaagaaggacctgagaggccttggatactcgccgtatgggtagttttgcggggaagtcgtgtatgctggtcaactttaacacagccatgagcccaccatttccccacacctttcggtgactgatgtaaccaagatggttgtatcggcataacgatagcccttggatccgagaattcttcatattgacaagtgcccggtcaataatacgacggatcggagctgaaagcattggcatggcactgatcagtatcaaaatgttaggcctaacgtgtgatgccgtgagtacgagaaagactgggatttgccgagtttcctgagtcccaaatggtatattaactgacccctttactcggactctgctaattcttaggcattttctcatctcagtacactagaaggacactttgtctactatatcctaattctttggatcgtatcttcgaaatgcatccagcacttcttacagcggcagccattacagctctaccatttgtgaaaggtatgcggtaccttcatatctaagtccacacgttcgcatgtttctcaatttcccatctgcgaccttaaccctaacaaatgagcagcggaaatcagttgggatcaggcctatgccaaagcaagggcagccgttgccaaaatctccatctcagagcaagttggcctcgctaccggccaaggacgaggcacatgcgtaggaaataactaccctgttgactccatcggttatcgttccctgtgcctgaatgatgggcccctgggcgtgagccgtgctacggccgccacagcctttacacctagtatccacgcggcctcgacctgggacagggagctcgttcgtcagcgctcccaattccatggcgaggaggccaaagccctgggcgtccaggttctactcggtcctgtggctggcccgatcggcaaaataccagaggcaggtcgcaactgggaggcatggggctctgatccctacctcaatggcgtccattctgccatcgccatccaagaaatgcaacggactggcgtccaggcctgtatcaagcattatatcggaaacgagcaagaactcaatcgcactacgatgtccagtaacatcgatgaccgaactatgcatgagatctatctttggccatactatgatgccgttcgtgccggagctacctctgtgatgtgcagctataataagctcgatggtgtatgggcatgcgagaatgaccataccctcaataagcttctcaagacagagttggggttcccgggatacgttatgtctgactggggcgcgcaccataccactgtgctgagcgccaactctggtcttgatatgtctatgcccggatccgcgtacaacagctcgagcaacctatggggtacgaacttggagcgcgccatccgatgtggaaaggtcaagaaggagcgcgtggcggatatggcactccgcatcctcgctggatactacaagacagggcaagatgggggatacccttcggttgactttacccgcaatgtccagagtaatcacggcgagaacgttcgcaagaccgcccgcgatggcaccgtcttgctcaagaatgaaggcaacatcctccctttgaaatcaccaaagagtatcgctgtggttggctcaggcgccacgaccgacggcgcggttgggatgggcgggggctcaggagcagcccgatacccatacttcattgccccgatcgatgccattagagaaaaggcagcgactttcgggggcggggtgacgcagagcgagactgatgacccggaagcgggcgccagcgcagcaaaagacaaagatgtggcctttgtctttctcacgggcttcggaacagaaggccgggatcggtctagcgcactggaacctgatgacaatggatacgatctcgtccaagctgtggcagaggccagcgagaatgtcatcgtcgtggtacatgttgtcggacctatcatcctcgcacctatactgaagcttccctcggtcaaggcgatcgtctggggtgggcttccgtcacaggagagtggcaacgctctggtcgatgttgtctggggtggtgtgaaccctagcggcaagctggtgtatgctattgcaaaggatgcagccgactataacacgaaatctctgcctacagatgatgactttagtgagggtctctacattgactaccggcactttgatagggagggaattgaaccagagtacgaatttggatttggactatgtatgtgttgccatcagcatttatacctgggtttcttaggctgacctcgcttcaattcaccagcatacactgagttcaagtactccgacatccagattagctctgaagcaaggagcggtcctgccagtggtggaatcgcccctggaggtcagagggatctgtggcgcgaggttgccaaagtcactgccaagattaccaacaccggaaagatcgctggtgcagaggccgcccaattatacattaccctcccggaaacaactgatacacctcgacagctgcgtggctttgacaagatccttctgaaccccgatgcctcagggaccgtggcgttttctcttctacgtagggatctcagtgtatgggacgcggaaaatcaagtatgggccatccctaaaggtaagattgtagtgaatgtcggagcaagcagcagggatctgaggctcgagggtattatcgacatcgcttaagagagttttcaatcagttgaatgggagtcatggatacgcagttttggtgtttctgaataagagaaaattacccccatcctgcatcagtcatatcgtggtctgacttggcgcgccgagacacgttaattcaagcctcttgcgagtggtgacaattgctagctgtcagacgaattatcaaaaattcatgacaagagatcaaccttctggacttattcttcatgacatcaggttgtgcaaaattgaagtttttcctaattttcaagccgtcacagttctgcaagttcaattaatcttaagatgggtaagggcgatcattattgtttatcgtttcaacaccagaatcatggaacggaacgtgtctgtgtatccaacaaaacaaatgaggtttgaagactgagcacaccaagttaagtgctgatgaaacgcgtaggaagcagccgatggactcgcaaattgtgtagttctcgtaccagtaaacttgtttttagtcagggggtactgatatctgggttttcaaccttgatgactatgcttcttttagcacgaccgcagcgtgcgtcttgtttctgtttcggtgttgaagcttacccatccgcatatggccttcactaatatcagctaacacatagcacgtactgtttaatacttcaatgcaggcttcacagtctcactggctggtttagtagcatggactaactggttagccagttagggtagagtcatgtgtggaaacaagctgaatgggcaaacaacctctcggaactcggaactacgggccagaaagccatccggttcacagcaaactataaatcgattactcaccgccagtaagaccaggccaggcgcggacgctaagcatggccaccacgttgcgggaaagagtcagtagcggttggcaggcctgtcgcggatctcgaccaggagcttagtcgacttccagagaagaaaggctctgcaattgagcaggccaaggtctctcgagagaccagaattagatctggaagagaaaagacagcaaggatcgtctccctctccttgcatcggacccgatcttgatgcggtcggacaagcgtcacggtcgccaagacccaaaatggaggtaacgcatgactcaatgaccaggaagaattggagaaaattggagaaataagctagtggatgttgaattcgccagattccaggcgcaatgaggctcgtttcttccacggctcgtctcatctcaatgttaaggccggagaccggagatgatcggaggcccattcgcagtggcaagtcggtgggggaagcgtgttgtgtttaattaagtgtccgatggtcggccaatctctccactttggcagaaaaattcttccttgcccttgttaggggcgttgggggatggactgagacgagtcggcgcaggttaagaccgtgctagggatagagtctggcgaaatttaggaaggtgggatatgccaagcgtgccacaaccagctggactcgtgttgcagcctggagaaggcaagatgacatgaggagagagagtcggggagaaggcagaagccgaggagcgtctgagggcatcgggcagggttgtgaggagattgcggggtttagcgcggggcgccagcagggcccctcccggttccagcgcaccatccgctgggccagcgcctgtgagtggctgctccagcgggactactgccaattctccagcagctgcttcagcgcaggacaagccacatgacggaccggttcgttgcgctgagcaaagccgaatgaataagcattggaaaagaagaaaaaaagttccatgagcgaggcttctcctggtctagcggctcgccctcctcggcccgtcttggcatcttctgctttcaccatgctccaaactcgactcaagaaactgtcagcgagggagggatcacccacggcccacggcaaacaaggttcccagctcatcccccggcatctgttgccccagcatcagtatgattggtgcccccgattccggcttggacggacttgcggagccagtgagtaatagtggcagcgttatttggctggtcggcccatgtggcacgcaggtgagagtgtaactctttctgctctgggaccagtccagccgacgagcagtaggtataaagggtgtcagcggcctcgggcagtaatctgctggttccccggattttctctgcgacatcttcttcctcctcgcaacccctccagcccccctctcgcgtctcccgtgctcgaggcgtgttcatcggtcgtctgtttgcttgctcgccatcatgtctgccttccccaacgagaagtcgtccggcgatgtccagtccgaggaggctgtcggcgcgactgtcgctgcgcccgtcgccgaggtccagtgcccgccgcacaccaccgagcgccgcctcatgaccaagatcgatctccacgtcgtgccgtttctgtgtatcatgtacctgctggcctttctcggtgagtttctatgcgcgtccttcatactgttgtgaggaagtcgtcgggagcgtatgtaatgctgacaggccgcgaaagatcgtgtcaatatctcaaatgccaatgtctttggcctgtcgagcgagctcggactcgagaagacgcaattcaacaccgcgctggtcatctttttcgtgccctacattctcttcgagatcccttccaacctgctgttgaagaagctgcgcccaaagtaagccgaacaccaaaccctccatccaattgcttaccgccattgctgaccgaagcaccaaaatagtgtctggctctccatcaacatgttcggcttcggcctggtcaccctgctgcagggtctcgtcaagaactacagcggcctgcttgccacccgtttcttcctcggcgtcttcgagaccggcatgtttccgggaggtatgtcgaacagcgattggcaagccgggtcgcctccactgacagagtcgcagcattctacctgatcggaatgtggtacaagcgcagcgaggcccagagacgctactccttcttcttcaacagtaccaccctggccggtgcctttggtggcctgctcgccgccgcgatcggaaagatggacggcctccggggatacaagggatggaggtggatcttcatcatcgagggcggtctcaccgtcattgtcgccgtcgctctgtacttcctcctgccctgcttccctgaggagaccaagtggctcaaccctgaggagaaggaattcgtcaccactcgtctccggatcgaccagggccagtcctcctctggacgcgaccgcagtgtcggctggaaggacgtcggaaacgtcttcaaggactataagatcattcttggtggcttgatgtactttggcctgattgtccctgccgtaagttcatattagccgctggcgcgaagactggaatcttggggatccgagactaacacacctccgcagtacagctacgcgtacttcgccccgggcatcatttcaggatacggatacgactccatccagacccagctgcacagcgtgcccccctgggccgtggcctttggcttctccatgaccatcgccgtctgctccgacaagctgcgccaccgcttcggcttcgccatcttcgccatctgcatcgccatcgccggcttcgccatcctcatcgcggtgcacaacaacacctcggtccagtacgccgcgctcttcctcgtcgcgatgggcgcctacacggccatgcccatcatcgtctgctggttcaacatgaacctcggcggccaccaccgccgctccatcggctccgcctggcaggtcggcttcggcaacatcggcggcatcatcgccagcttcagcttcaccgacgccgccaagcccaagtacatccccggctacagcatctgcatctccttcaccgtgctgagcatggtcgcggtggtggcgtacgctgccgcgtgcatgctgcagaacaggcagaagagccggtcgagcgacgacggactcacgcaggaggagaaggaggaccttggggatctggcaccgggctaccgctacctcctgtaatgtagttagtattaacgtacattaaaaaaatgtcaatttttgtaaagcatggcattacctacgagagtcagatatgtgtgaataagaggggttgtgtgagtcagtcgtagcgttgcattgttccgactccgcacttggtgacgacctcaatccttcaatgcgcgcgaaccgtgtataattgtcgtaggggctcggaatcgcagccacaacgcgccatttctaaagctcaaatagtttcagggccaagaaaggttgcgtgagaagaaaaaacaagaaggaattgctgggttggacgaaagtcggggggtcgtggagttaaattgcatcgatctcggcataggcggcaaggtacggctagcaaaggcccagcaaacgtctctccaccatgggaacgtcgaattgaatgcaaggagatcctcatcccgggaataatccttgactgaagatctaattctcagggaaaatccctcatttcttcgttgggctttgtgctgttgcgttgcgatggttggtcgagattggggtctcccgagcactctccttgtcccctagcttgcagggcgagaataaaagcgattgtgtgttgggataaggcataatttccctaatccaggcctacgtaagctgaaacgcgcctaatcagagaaggtgatcaagtgctgaactgtgtggtacatcactccacggccgtgcgttggccataatcgacttgaacaggcgcttttgtacattatcttcgtgatatcattgtaaatgaacggtaggcagtagtatgcactgaaattttgggatctgggatgcctgtgttgggagatgagcgacaatatcaaatgccttttcctcagggccaccagtgcaatacaatgtaatgccttttcaagcacgactttctttgtataccgggaatcaagaggcgtcctttcagaccagaaagactactggggaaattacgtgaatttgtttaagccaatagcgaggggcgaaggctcagccaatccaacgcgctcaacgcgcgcaggcagccaccgatgccgtaactgacctagaatatgtttgctttttctggcgttgcacaatcagaaaaacaaagagcagaaacaggcaataaaatgaagcagaggatttcattacgcaagaataagccacgtagtacgccagattcccaggctgtgctagcaactatgtcacttttttatatcaccttgttctttggagatcttctgcgttttccgttcgatagttgattgttaacctaagaaaagaagcctgtcgccgaggctttcatccaccgttatttacaaagtcgcaaaggcacgaacacgactccaccatgccagaactgccgcgttactacgccacaatgcgttctcgtcggctgagcgtcgtctggcaacacgagttccaacttagacgaacaatttctccatcttctagcatttaatcactttgtgagcgcctgtttagatgtagtttggccacttgtggcatccatgatattgtgcctgcagacccacgatgctcaatgcaagcctgtctccaagcacattgctctcttaggcagttggctacactacaactgaacaatagaataatacgttgtttctaaatgtacttctttacgttacagtcgcggttgaatgcgttgccttggtggtgaggaggttactgtgactagcctaccttcttagagctctgcttagaggcttagactttgtttgccctcgcttctattggcagttcttggactgaaaggtgaagtgcacttctctaaattgtatttctcaagagctcttttctacctataaattctaccctgaatcctcgtcccaaatcttcacttttccgacctaactcttcactcactcatcccaagttatcaccctttcatcccaagttgtcacatcgattcaaatcttgctgccaaatctctacctatcatcgaggctatcgatcggtcactaccttcgttctcattcccagaaagcaaaaccccttactgagaagcttattgaaatctcagctatcatgcaaccaaacgccggaccagtccagtcccgtcacaggtcacaacaccgccgtcttgaaccacgcatacaacaacagaccacgcagtcgacggactttaatcagttcgatgctaacaacgacgaggtttttatcaataccaacaactccatggttgacccgcagctgtggcttggacagagcatgcctcaagacacgtgctggcaccagccaggctacatggccggtccttccaatgtgccagccggacactcacttcccgccgaaccatccctcgacaatggatttcaagctcctgcaagagtgctgcctccctttgttgaatatgttcccgaccccaacttttgtccgcatccagcacctttacaattcgcgcagactccaaacgcctatcaaggcccagcatggcaacgcccatcctacgaatgtgcccaaactatcccgccagcaacgtcaaatgcaggctactcaagtctcggtggccatggatcaccaagcgacttttatcatggcgttgctcaaccaagtgctctgcaagcacagaacactgtctttcacgacgcttctcaaacaacccctcgacgagtacataagcgtgctcgagccgatgatagcggccgcgatccgacaatggcctgtatacctgccagattccgacggttcgaaggtaaaatcaagaaaacgttcccaaacaaagtcaagccaccgaccagtcgagacaagaagggccccatcaacgcgccggaggatttcgatgaccaccagctgatccacgactgcaaatccaagaagccagcagtgactggcgggttgaagtattcaaatctgggggaagctcgtgccaaggccaaggaatgcgagatcttgttccacaaaaagcccgaaaagtgcacctatccatacaacgacgagacgttcccactcactgatgccgagtggtgtttctatgccctgttaatctacaacgccatggtcaactgggagtcgtaccaggaatggatgaaatgcttgcctgacgagctttgcaacaaaaagcagcgtctcctcaataaaaagtgcaaaatgcgcatggagcgacgtgttgagatcttgcaagccagacagtccaacaacgcgtccgcgtcagatggcggatcaatccgagccgacgaggccgacgacgaagacgtcaataggccgatcctcgagctggccgatctgctgcccaccccggaggaggccaaggaaatgccatctcttgcacaccaacaagaaaaaatcctgggaagaactttgaacacggagatagctagcggagaatcttggcggcttctcgattgtgctgtggcggctcagcaaggtcgctcgggtgtgcgtccggggaccgggaaggatggctcgtgggagtcgtatccaagctttctcgagcgcatcttggctctggtggacgttcttagaaccacaaagcagaccatcaaggacttaatgagcctgggagacggatggtctcaacgcctggccaataacccttacggcgaacaggcgaataaggttgagaaccgtaagaacaacttggggaagaagttcacgatggagaagcgagccgaggcagccaagggggctaagaagtcggccaattagatgaaccccgcatccggtgtcttggctactgcgacgcgtaagcccagaggctcaccttccaactctcaacatctaagggaagctggagaacgtggcctctcatctgtagactctagggactgtcttatagaccccggaagcctagagaatgggagtgaactcggccgcactctgctgactacgggtgatcatagccaattggaggtgtcccgaagatagcgcggaggccgcaggttgcgcaacacttgagatggccgtgagaggaggagatcggaggcaaagcgttcggaaggcgaaggttgtttgaatcgttcacgcaattagttggagtcgaggggttagttagaaaaagaatttgttttcacatgctacatttggagagttctaggattgttgtgcttatatatgagagcacgtctgctagtctagtgaacgctcgcatcgtgctgaagagttgactgatacagaattgtattgagaagtattgagtcaacctaatcctccaactgtgctgaattgcgatacgtcctaagttcattccaattctccaaccttccagtcggaggtcgtcgaatgatttgatgagcccgagccgagatctggctgcgctgaataaacgcctcgaactgaaacatcccacgatgtgcttagttccagtactggaggcgccgatattcctccttttattgtacagctttcggtgtccttgagacagacagctgaaaccaactccaggacaacacatcttctgcccaatcaacattgcccgcttagagtagccgtgtcgtgttaatgaagggtaattcagagacgaagtctcttattctgagattttattctttccaacgtaattaaatcgaatagttacagcgctatttgaagctgacgcgacgttattttatctttttgcgagccatcgcgtcgtgaacttggatcggtctacagctgtaagcatcttcaacgagaatattctaaacaggttctacctaagttgggtttttgaagtaatgattcctgatgcctcatgttcactcctgccaaaaggtttcatgctatcttttgattttaggaattgaaatgtcgttgcagcctccgggagtgctgagagaagcttggcatgaagcggaagacagatgcaatgccgtctcaggtccaggaatcatcgtcgtgagaaccagttccccggataacaactcggcccatcaaggctagcagcaacgctgacgactgtgcaagagccacaaacctactattgggatccctagcgagggctcgataacttcataaaaggcgggctctcccaaagcaaaaatggccacatccagcgagttggtcgagcacctcccacgtcacgagctgcaagtactcatagacattgtccacaacatattggttttctaaatattaagttctccatctgccaccacagtgctcagctctgtataataatcgtaccaacaggttcttctccgagactgcttttccatctccacctcaaataaccactgccgcctaactatatccttcagaggccaagcctcaaacttcctccatacagagtactttcagatgccctttttgacgagataaccttgagctccctacgtacagtgactaatcggacggccgatagaactgcaagtaggagtggttgaactaggttggccaggaagagtgggagggcgatgctccttccggcaggtattgggacccctctaaaaatcgtactcgtagtagtcgcgtgcttcaagatagtccaggtagtcatccagtccacgacgacgacctcgtgagggaggagggggaggtggacgagtgggaggagggggaggaggaggagtgtgaggtcgaggagctggcttctttcgtggagggggagcattcgggtcaactttgcggagatacatggcccgacgctccagatagtcatccagtccacgacgacgacctcgtgagggaggaggtggaggaggacgagtaggaggaggaggaggaggaggagtgtggggtcgaggagctggcttctttcgtggggggggagcattcgggtcaaccttgcggctatacagtccacgaggccttggaggagggggaggtggccgagttggaggagatggaggccggggtagcggagccggggggggagtctttggcttctttcgtggggggggagcatttgggtcgtttttgcggacatagagctcctcctcgatgtcacgagcatctaactccccaccaacatcgatacctcgggcaacaatctgctcataattattgtctcttggagcaaggtcgttggatgtactatccaactgggcaagtccggaattgacaagaccgagacataggacagcagttgccccaaagtgcttaagggcaaccattctgagactttgagatcaactctcagccaaagaaaaatgatagaaagtgaaaaggaaaacagcaaaggaaaggtaaggagtgattgttgttttgtctaaagactgttgtatttagatcagtttcaagtgttaaagatggagcaggagctgtattaaatagttttccttattacttgtgatctgcatctaacactatctgagtcagatcttttgaatccttcacatgggttataagacgaagtttgtccatatttacaatagaagtccaatcatggcatcctggctcggcattctggctcggcattccaacacggcattggtatgcagcattaataagcgggatgagcaggcgtcttccattatacttcctcttctggccctctaaataggcgatgtaagacgaaaccatttccttgaagcttcgaaagcgatagcaaggtatcttctccgcttgcgtatgctgtacaagacacggtggaagaaacatgaagcccgtattcccggtgcgattctggctagtggcgaagtctgccctagtgaactacttaccaataatacatcaacctccacgttagataggctatacacaaagtacctcttggcttggttttattgatcgtttcacagtagaactccgaatatgacatcctagcacatcattgagcagcgcaggcaggcagggagttcggttatatctgatcaacagacgatgttattattagcacgcgaaggtttgcttgcacaaagttgcagcgatgctcatcctcagccacgttgcctcccctgaagatcccacttccaagacctccaacttgaacccatttctctgatggaaacaactaaggcacctaaccggtatttcctccactaattttattttatgtacttcgctggtgctttaagaatcgagtttgatatgcgattatcagttgcggtgaggttgatctagataccatcgccacttcttcttgcgttagtatattctaacccactttataagtatctgttaacgggcgattatcacaccactctctaccttgtagagtacaagttggtgccttggctgttcccatgagataatatgtggccttgacttgaagacctgctaagctgggccatggctcgaacccctgggcttctgacatatgagcaggctgtcttatagaaaggtgacttttggcatgacgccgagcgcgaccaaagcttaggattgacagcatttcgaagccgcccagtaggctctcgccgtgctgccggtccggcaacaggtttgcactgatcgcttaaagcagcccggcgttatgcgtcggaatactctcatttctatcacagacgctagctggggggttgagcccattcaatggatggctttagactgtgaagtaggtacgtgagtgagcgatacgaagtagtggatttgcagaattatgcagcaaaacctccttttcgtattctcctagatgtgtcgcctcagcgtcagacagagtgggaaattaagcggtcacaaggtgccaagcaccaaatttgttgcatccataagcctgtccctgctcgtgtgacgaatgcattcctttacggtgctgggttttagcgagtagggtggaacacagcaaaaatcactgccaacgggtcatttttcgatttttcatggggtcgatggcatgaacggggggtcagtgcagtcatattgaccccagtctatcggtttcacaccagttcgtactatgttttccggcaggccatcgccaccaacgttcaatacagtcagcctgccaagaaaggtacttctcagtacaatcttcaacaatgaactgacctacacgtctgccgtcaagacaagtgatcgctgtatgactaaacaggctgtctgccgtcaagacaagcgattgctgtgtagctcaagaggctgtctactgttaagatgagcgatcgctacgaagctgacctatgcgtctgctgccgcgacgagtgattcctgtgaagctgacccataaagatgacgtagctgtcggtcgttgcgatgagtgatcgctatgtagctggacaggctgcctaccgtcaagacaagtggccgctgtacagctgacctccgcgtctgccgtcaagacgagcaatcactgtagagccgacctagctgtctgctatcgcgatgagtgattgctgtgaaggtgttctagctgtcttctgtcaagaggagtaattgttgttgttatcgttgttgtgaccatgtgacctacgcgtaacgcgtctactattcagacaaacgatatctacctactgacgagacgaacaatcgctgcagccctggccaacctatcttctgccgcaacgagcgattgctggagccctaaccgacctgtctgctttcaagtcgagcgatcgatgtgcagctgatctggctgtcaatgggcttgtggcgtattttatatattgtatgtactagaagtcacttttccggatgacccaactgtaaatacctaatcttggcggggcaaattagtcttgaataagattaactgataattatgaggttagtttgactgcactgggcataaacggggataagcttacgtcttgagctaccctatagtaaaaaactgagtctaagaaattaggagatatgaatataagataaataattttaagaatattatatagtatatattaatatgaactacttaatgatagtcttttatacttttatttaatttatctaaagtattttagttaagaatataattttaggaggattatctatatcttcttctctcagagaaactgtaacaatattgatcaggaataccaagatcactcaaccataatatcaagccagccgcccaggccttgcgactgcttcgttagtgttatcatttgatactgaaaattcataccagtcatataaggtggcttccatagcggctccttgccactcacactcactggctactattatatggaactgttatataagctttgtgtttatgcacaatgaggcttggcccctggtccaggttagctggggctcggctctagtaatgatataatagtagttattattgtgttgagatgtcgggctctggtattttctattactgtttaactttacactcgaactctcttgagtataatagtagttataagtatatgttgaagttatatagacaatcccaggtagccatggaataggagtattgtacacgatatatagcagagtttgccacgagccacgagggtggaccttagtgtctatctttacctgccacagctgtacagtatatacaaacatgtagcatggcatataaacctgcttggtataataaggcaactagcggatattgcgaccagtaacgagctctggaacttctacagcgggtatactactacaggaaagacgtctcttaacgtcaaaccggaatgtcatacaccaaccgcatcctccgcgtaccagccattctccagcacgacgatcacatcccataccggacataccattataggatttcagtactccaaggacccaaaaattgccgcacgatcccgttgagactatttgataattctacaaacaacgataggcatagaggccgggactgcctctgctgagtctggcggctgcaactgggagcataagttgtgatacccagcacagtacagaaaccagggtgaggcgagctgacacgaagcagtgacctagactttagtcgcagtcccggacccaggacgcaggagtttaacagctaggcagtaacccagcagaaaattaaagcataatggagacataaataaagcagcaagatatagaagaaagatagtatatataaaggaagcaaagaatatataaagattatataaggagtatataaggaagatgcaaggatgagcacagaaagtgagcatgaagcaaaggcaaagaaaaaagcacgaaagagctgtatgtatcacagtacagaagagatattgaatcgctgacactgcaatatctgcaattccttgcccctaacacgggagctgcacgctaatccatccatcgctctaaaggccgcaagcttgcccatatttgattgcagactctgctagtgatgagcttggaaggggtagcatgctcaatgtgcgatgccatcattcttagcattggcatgccgaagcccgaagatctatctctgtggaaaaaattagcctcggtcagtcgctagaatgtgttgtacgtacgcaagcgattcgcccgcgtccgagtagagaatgagaaagaatggcggttccactggaagctccctcggacgcctagcaaactgtgtacgctcatagaccaagcccgtcgtcatttgatgatcttgtgtacttatgtatttttatgataatactcgaaacgctataggcacgcttcaactgggcctgctgttgtcgatagtctgagctaacgacctacttgccagtctccaacaagtatagaagctgaatagtagcaagtcttcacactattattgagttcacttggcgatacatgatattatctaggtgtttataggccgtaacaacccggggatccgaattagtaatattcttgggcagtatcgttactctaagtatagaaagctaccctagtagcgctatcctataatgcttgacaaagagtttcaaccggtcgcgtctgattactctataagaaatctccttgacgagctccagacttttttctttataatatgccctcgcgaggtgttggttatataactacttatacttcgatcttgtcctcgactcctcgctactttgcgcgagctcgtttgcgtcgcccaagcttctctttgccgcggggttctatgttggttatatcttcctcgtcaatctccatggcagcgtagacggcattgagttcgtaacagggatccaatcccttatccgcctagcttgaccgcttcaatccttataccgacacaataagccctcatcgctgctgacagcatcaatcggatcgtgcctgtttgatgcccgcgatcctgttcggtcgaattgctcgtgctcgccatgctcgcgagatggaagcttaccattctgttcgtgagaaggctgcggtaccctaggcgttcgaaacaggattggctccaacagttgcaaaagaatgtcgctctttcggtactcgacgatgttagcagctcagctgctggcaccaacatttacttttgccaactatgtaaacatctttaatcatattttcagggttctggaacagttattcctgatatttcatcttgactgttgccaaaagggtttatgctatgtttcgattttgggaattgaaatgtcgttgcaggcttggtaagttaacttaacgtagtagcggcgagaaacgcatcagatttattaattattgttaaatctaggaaatcattgatttaagacacagctagtcggtacacatcataggtcccaaggtggattgctcatagctacaaacagtcttaagcccccaggcgaggaatgtctcttgctcaaggggagtaaggccaacgctcaattcatcggacagaccgtcaagctcaacacagcacttggtgcaatttgagcgcttctggggacccgcgttagtgcccccacccgctaatccacccgctaaatgaactgctattgaatcatcgcagagccgcattggcctgaagtttaacgcaggagtaaagtttccttcacaccgcgcaatgagtgtcccgccttggatctagaggaccactcaatctcgcatcatttgtttcagggatacgatcgtatgctgacggccagatgattaacttcccgaccgcataaattatcagatgttttgctgcctggaagcgcaatactcattacgtactgaagtccacttggcctcgccgcttcggcatgacgtgcttttagacttgcagcacgccttcgggaaccagcacctccggccggcagctcagccggtggccccgacacccgctgccatcaccatccgttgattatggaccgagatcttggtaaaattagatattaatcaatatgtattatgggaatattctatgaacaagatattctctataccaacaggctctccctctctatttatctagacatctaaataccgcaaccccttctatctcttcaattaggtagctctactccaccagcggcttgcgaacaaacactctcctctcccacccatcgatatcgtccaccaccatctcctgctccagcctgtacttgccaaagtacggcatgagcttggtccagatgacccagtagacgccgccgaggccgatgacgccccaggcgaccacgttgtgggtccagtacggcatgctcttgtagatgttctggccgtcctcgggcggcgcgtacggggcgaagacgaggaacaggttgctgatgaggaagaaggccacgacggggagcgtggcgctgacgggcgggttccagccccatttggcgcggttgacgtagaggtagatgaggccgatggcgacgaaggtgttgacgatggcgagggggtaggagatgaggctggattgtttgttagtttaatgaaagaatttacacacaatactgaaaactcacttgatgacgaaattgtaagcatcgccggtaggaggggcgatgatggtgatgaccgtgacgagccagtgctccatcagaccaggcagaggggcgttgaagggacggttgctggcccagaaccgcgaaaaggggaggacgccctcgcggccgagctcctggatgagacggccctgggagaagatgacactgaggacgtttccgaaggcagagagagcgacgaagacgcagagggcacgctcggccgactcgccaaacatgttgcggaagagtgaggcagcgacaaggcgctcgctggtcaggatctcctccttggggacgccgacgaagtaggagatgttggcgaggatgtacaggattccgacacccaggatggcgagcggggccgagatcttgagggtgcggatggggttcttcatctcgctcagggcgtagttggcgttgctgtagccgacatagctccagatgacgttgttgagggaggtgacgattccgtatgcgctgccggtggtgccctcaaaggccttgtgtctcgagagggtgtcggttgtcttgtccaggcggacgagaggagcaatgataatgatgaggaggatgatgattttgatggatccgaggagattctggagacggattccccatttcagggccgtgccgtgaatcaggaaggcggcggtgacgacacccagaccgatacctcgttggttccaggtggtgggctcaacgcgggcagcgagaaggatgtattcgccaaagacgatactgttaccggcgcaccaacccagcaagacgcagtagcttccgtagagacaggtggtgagaaacctgggcttgcggaacacgtattcgaggatgttcttttcaccaccattacgagggatacctgcgtgacgattcgttaggcctgcagattatggcatcatctcgatgggacgtaccagttccgaattcaatatatacggcagtacccgccgcggcaacgatggtgccgatcaaccacatgatcatggacagaccagccgagccgctcaggctgaaaatggcactgggcgtagcgaagatacccgttcccaccatgcggttcaggatgaggaagcttgcgccggcgatgccaattgtgcgcttgttctcacgggcctgctctagatgacctatataattatcgtcagaactgccaactaactcaatgacgggttcagtagctaccctcttcggagtcgaacccggccgtgcgagggccaggggagtcctccttgtcatcctttttggactggaatactctctcgacgagactcatggtggatacgtgctaagggaagcaaaccacttgacggttaaacaacgacagtcttcccctcgtaggcaagagtggatgagcagatcccacctggagaacggtggaggaagcgtcgaagctttatacataatgacagctgttttgcccctcgcccatgcttgactggcgtgactgattcaaatcaaagttcccgcggtggagcaggctcttcgcgactaacagaaacttcctccacgggctggtggcgtgggtctctgggtcccggctcgtcgacggaaagatttgtgcatgcgtagaagggccgtggaagctcggccagggcgccagtgtgtgtgagcagggcgggtccagccgacgccaagtggatggtgacatgcctcagggttgtttttggcagattttttacgtttccttttctctccttcgcccctgtaatgaggcagcttctctccgtacaaggccgtcaatacgtggccgcttattatgtaccattgatttgaataggggaggcttattatgcctcaggtttaagatgagtgaaggcattggaatgcagtcgcggtttgtcttgctagatgactgagttttcatgttcctcgccgggtattcatgccgtatgccgtacgagctgctccccgtcagcaaaaatcagacgacgaaatcatgttcaccagaattgagtgctttcagtcaaggcgccgaaggtaagcgcttcaaacctgctgttcaaatccagggatccgtggcagaggatcgagagtctatgtgtcatgctttgcggtttgtggacgaccgggacgatgacgcgatcggcttccatcgaggtggaaatccaatgagaatccaccgacatggtaacactgcgggtctttcttagcggacatctgcgaacaccctcgagattggctgttgcttgacctcgatcacttgcaaaagggccgcccatccctgtatgcagacggcgaagaggacgagaagcgtgattgcggctcgttcgggcgtattatggcctcctggttaatgagcgagataccatgaagagctggtctttcgattccgcttgttggacccggcgaggcccatcatccgaggcgtaattaattaacaccttcgttgctatacgacccgagtttcaacccaagccatcgattgataatagctctcttcctgcagagccaactagcagaaatcctcccgcatttgaaacaatacatagtacatgattttcagtgtggcttagtggcggagtaagcgaccaaaatgatcagcgctatgcggttgcgccatagttacccgtattcgcgatatcgacctgagagtgcacagatacatagtttacctaactgaatttttcaaagacacccaatggaaagaagattgaggtgtctcatccccgtgagcatgtccataacacatgtttttcgcatggggtctcacacctcgctcacacccggcaggagtattagccttcttgggggtccagcaccggtgcattggctgggaagagcttgactcggaccattatgccactcttcatcgtgcatgtgtaacatgtgtttgcctcgatagccggattccccggctcttaccgtgtgtgcccacgatgagcacaccacccttgcctgcgagatctcccgctccctcaatgatccaggtccacgggaaggttttacagcaaggtggtgttaccgatgaccttattgagtgaccttgggaaaaattcttcggtctactgaccccttcagccgcaaccgagagcttcaagccatcacgcgtttctcacataccgtgtgatgtgccgagattactggtgaagccaagatgcccctaggcacctcaccaatggaaagaggtctgtatcatttgctaaacttcgggcttgttttctacttttgagaaacccttggcattggcgcaaagacaaaagttcgtcttagcacagatgcccaggcctcacaaggcaggacactcatactgccaagcgatgacgagattttgtgcccggtattttctatcaaggttttcagaaaatctaccaatgtcctttgttggtgttatttatgtcccagccaagccgtcaagccttccgcaagtcgtgaggcggccgcctacaagatgtttgcttgactaaggcgacatgggtgacttccaagattttggtgttggacttggctattacacgtggcatttgactaaccgttaagtgtctccttccgtgatttgtaagggcgacttaccctcggtgtacaaagacgtgcttctagacgtcttcccatccgcaacagtcacaccttgaattcttgctagcacatctgataatacgtctcacctatttctattcatgtagatctttgtagatctgtatatatttatacctgcggcttccactacttagcagtatggtgatattataagcaataaagcaaggatgtggtggtcacaacaatgctaccatgccacaaatcggatatctgcaccctaatacctgtaagactcgctacgcagacagaattcatgtgacttggaatttaacaaggacagtaatacctgtcattcaatcgtcaggatcggattttaccttctcggtacataaaaacatcagttatactgaataaccccagttacttacttctaaataacaaaagacgcacctttcttgtcaagtcattgataaaacgagactataatcaaacgtccgtactatctcccatcaaccggacgtaatcggcaccttgagatgatgtcggcgccgatatgaagtcaagtagttactccacctcccccccctggcatcgactccggcatcggcgccgaccaaactaccctggtttcccatcaaggcagtaaatccacgctttacgacacatgtcccgattatccaccccgtggtcgttttcaataagacactagatgttgagccggctttttgggtccgtattgcggcccccccggtggtacgttgacggaatcacacgtggctgttgatcacaccctgtcactgttacaagccgggagtgagaattagcgacggatgttttgcctatttcttgaattttgatttgatcatgagttttctgctggaacaagtgtcgattcctttgagattaccgctaccgataaacatctaagccattcccctcggcccatctccacgctacgtaaaccgagatacacaacccgtcaccagcgtcgtcacctatgacaacactctcgtcgagccggatatctggttaattgatgccgtcccgttcaccttggcacacgacacgtttcgcgtagagtacagctcgccatccttccggtccgagttctgccaagcctcatcagagcaggtcaggttaaagatagtcccgcccctcgccgtgaacttgccgccgccgtccccgcagacccacgtctggttgacgagcacctcccccgtggcgcggttgaagctgaacgaggccgcgtcgcgcggggcgctggggggcacctggcagtcgtagacgacgttgccgtagaagaagtcctggagctggctcgaggacgcggcgcagacgggcctgtactcgagggcggcgttctccagggtgaagttgacgtagccgccggcgatctggtgggacggcgtcgagaaggtgtaggaggagtggaagtcgaagtcgataatgttccagctcaggatggcgcgggatgcgtttctgcaggagagctcttcggcggtgagctcgacggaggcgggggcggcgagcgcggagcccaggaagaggagggagctcagaatggcgttcatgttgacttgattttttttcccctagatttaatggtccgggttccaaagacggcagttgtgttgaccggtgagcggtaaatagtgcgggcagtcgaatggccaccaactggaaatggggtgggttaaaaggaagatcaatgttgtggaccgaagcactcagataaactggctgagtgtcagtgctttgtcttgctagaaacgtctggttgttgtattcatcaaatgtgggttacgaggcgagtcttatatgggcaacctctcgtgttaactcagggagctatgactaaatagcccctaccaggccatatgaatcacaaatgtcttggatcttgttgatgtatgacgtatcacaaatgctgtgcagtcaggcgagacaatttgacgcgttaaaagagggagaggcgagcagtccttctaataattcctctacggctcgtacctggtggtgaaacacgtcgtctcaagctgtggggtgcgtgtaggcggctgtcaatgccgcatgactcggtctccacggtcatgttacggggtaatgctatggaggaggcaaacaggggccatgagatttgcacgtcggtgtaattgagcgctacgcagtggcgaaaatgtccttgtactctgatatgacaacgtgatttcctcgccgagtcgcccggtgcggtcccaacaagacctcaagaagatggttattcaggccaaggtcttctggaaggaattgcggcagtgcgtgcatgatactgcattgttacagtggtcgcagcttgatcgtttcaccgcaatcttgaaactcgatcacaaacaaccagccctgtgtaatggtctaagcccaagaggatgaaaagaaagctgtgcctgcattgatggcaatatactcagcctttcaagctgccacaactaacgtttgtgaaggctatatgcaggaactgaggaatttctatgcgtgttcaacaacgcgcggcaatatcactagacagggtccgaatcctgcgttcctttaagttaattaaatccatgaatgtaggagtgaccgcgcgggtcggacaaggtctagcacgtgcttctctggtgtaaaagtcccctcttttcaaccagtttgatcctagccatacttgagcaatgatcttaataacattgaatgatagctatcactaaacctcccgactcttaagtcatctcaccactttgcttccacccctaactttcaaggccttctcttcccttagatctcatcctaaacagatcataggagacaaattctcttctgaagtacgatttacttaaccacgctaacattagagacatatcgagttctatcgcaggtcaaaaagaaaatagggcactgcatctcgcagggacgctctaaacaatttgaatccttcggttgcaataattgagaggaaatattggaaattcacccagggcgtgacgaatgcctacggtttgagagcgaaagttctgaggcggatgtggtgtttttgtttgcacagaaaagctcttgtcatctacgcgttcgattaattttgagaagaggattaatgccatagtagcttctcctttagcaacttccatcagccaaaaggcagagaggacttctctccgtctgccacttgggctttcttcgtatggtcattcttgtttctgggctcgactaccaatatagagttgaagagccaaccagagaacaagaatgctacaataaggaagaagtcagagtcatttgcctttgctgagaacataattagatatgtgaccaaagcgatgttgaaagtgtgccgcggaatccgcgagagccatatcatagtggctgcttctctagtatcctatgttcagtcagccagagttaatatcataggaggagcagtaaaacctacatcagataggaagattggtctgtccataatcgtcccagtaatggagcatgtttccatcaggaatatcccgctagataatactaaatggataaccgcgccaccactcgctcaccattggtatgtctgtatttcctgctcgctctcgaattgaccacggcgaacatcaggaaagtaatgccacaccttgatcgcccgataaatcatccaggcatagactgacagctgagatgtaaaagacattaaaatatccaacaccgacatcgcacttataccaaacatcccacagttgccaaacagatccttgaatcgaggcctgacatcattccacttcctatcgaaatcctcgagcagaaagatcaagttcgtcgaatcgagactcatcatgtttaaatacactgtgtatttccggatgcttccaccagtatagcgaaccaaatcgccgatacaatgtatcacccccaagccgccataggagcttttgacaagacgacgcttgaacatgtgatcccagaaacggaaagcgcagaatactggaatccaactaactctggaagttttcgggacgaagccttgatgttcttgactcatggttaagaaaaagcttgcaaatgaaagactaacggtggacactgtaagcattgctgtaagctgaacaggcgagaggtcttgctgtagatatgttgagactttgtcgacaaaccagatcggaggaatttttgaggagacccctgacatgaatcgcccgagggctgttctgtcggagagtgtttccttagatttagacatcaggggaaagtttaccatcgaatgacaccggaagggaagcatacggaagaaagaaaaggtgagcccctgatatagacatgcggtgagtttattgcaagtacggcgggccgctgtgccacgatccatggaactttgttatcggaaacgccttatttcggccaaccccgacactacaacgattcaaataaactattaacacaagggttaggtttaagagggcttaatgtagatgaaatagcaaaggatcataaagagatattattcctggactacctaggtaggaaaagatgtaaagtatatctaaaagaagatcttagctatcgctagaacaacccccctggtctcaaccaaaagattgcaataaacatccaagtctgtcatcctttcccctaatgtctagattaaccttgatacgaactgactgctatagtgacttgtatgcaatctatactaggcattgctggacacgatatgtggattgcaagtctactgtttagatctctttccgaattccaaacccacatccgtcttcataatgaccttgtttatggcacttcgagcaccatgcatcagtatcggagtgggcaaacccacattgtgtccccctgggacagtaggggtaatcacggcaccgggaagtcttccacttcgtgaagttctggttcgggaagtctcgaaacagtgtcttctctttgtcagtatggtaacggccacatgcagctgctttcctgcagtgcaggccataggggcatgcttgcgttcgatgcatagcgcgacgatggactctctttaaatcgtttcgaggcccgactgcttcccagccgtcgaatgctcccgtatcgatatcatcactcccactttgtccgactaatggtttgggacgatcccacccactccaaggcttagcttggacatcgacggatttagtttgttcggtggtaagaggagaattcttctcgccatcattctggacccatgaccaaaacatggttcctttttcgagagtaaccaatgtcttcttgttaagacgagatgaatactcaggccatgactccactgtccagtagtctttgaatagctctcgtacacgaatgataacgccctcaacattcttgagattcggaaactcgacaaacagtgacgtctccgttcgcgaccgagtgatgtagaataggaaagggcagttctctaagaggcagctagagacagaagcttcctgaaaatcaataccattgcccttgtcattagggttgcaaaggacaacagtcttgtccacctcgactatcttgcccgttcgtgtggagcgcgtgttggtaaagaatattcgattggctatctggtccagataatacacccgcaggttgccgccctctctccttttatgctcattagagatgcctgacttccaggcccagacctctacggggatgccacattctagtgttgcaatgattggcgggagcatgtcgcgatctccggagaccacgataaatgtcatgttgtttagttgctgtttaatctcctcgtcatatttagcgccaacttcgagcttagttgcctgaaggctaatatccgttgccatagagctgtccacctgtttctcctttccattattggcgcggttatacacattgaccttaagaccgaacctctcgtatgagttccatactgcgtcattgggcggcgggcgcgagccgtaaaggaaggcaccttccaccgagcgaccattcgagattctgctaacgtgcttgccgatgttgactctatagcgcggatcctggtcgcagtcttcgagcttgggtaagcggctcttgcccgaggcagcgaacttttgggcttcgatccagacgttagagtcatccccgaagatcatgcagttttcgttcatgtcgctactcatgttgctgcaagttcagatcaaatcgtacctagttaggtcgaggataagcgggcaaatagttctcaaggcgaaagagtgatgatgaaagaggagatgaacacgtatctcatggacgaagcggccaagcaaaggcgagatacggtccgtaggctgcgctctttaaaaccaaagcattgaaacccaaggcaacaacgttgagcatctttgcgttggtggcgcacggaggtgcagagtgaagggccacgtgaatggatcactgtctacctatcatgaagagccattatacccaaaaggggttgcagtaaagcatgcaggtatcggataagagccaatcaatggttcgctgttgacacactttggatgtgtcgtcctggtattggtttcgcttagtccttcttcggtgaggtgggcagtcgtacaatgaggcaaccgaatgaaaccacgtcaagatcgatcatttcatagagccctatgtcattggtagagtgtacggcctagccatgaggcacgcacaggctttcgctgtggttgagcgagtactcataaggcctggttttattcttttgagcattctatatatacaactctgaacactttatcataaagactaaatcttaagatgggtggctcagccatgctcaaggtcgcttgtttgtttgctttcttataataaaaaaacaggcagtgataaaataattcattcataacaagtaacgtgctggcttctatcaactcagcttcgttatttaattgttgtggaagcgtgcctgtgagactaaataataggagttctcaatgatctcgcacagaaagagcaaaaaaactacctgatcacctcattctgtggcgttgactcccagatatagtctctacgacgcgatgcgagcttcgtaggcattccaaccttccctctgatactgcttagcagtttcgacacggttctctgatgtgtagataccccgaccaacaatgataaaatcagaacctcctttaacagctgcctctggggtttgatattgctgtcccaggatgttcccagattgacagctattaacaccagtagtgaagataagaaaatcctcctgtgcagatgtatttagatcaggattaacagtcccaagtgctccggtagccacgaagccaataacagcgctgctctgttttgcaatgtcaatacatttctgagtgtattgaccagtagcaaggctgccagccgtggtcatctcggcaagcaggagcacggccctctcatcgcggtatgggaacgtctcgttagagatgacttgttccaacgcctccacgacgcccccacctccaagaggactcacattcacaatatctgcccactcagatatccggagtgcgccgccatggtactgcttctggactgtcgatccaatatccacaaacttccgatcctcgaaaatcatgaaattatgtttcgccgcaagcttcttcaatccaacttccgtcttctcgccaaagtcgtggataatatcgacgtgtgtcttgaatacagcaatatagggcccaagttctgttgagaaaaaggtgtttagtaagcttttgagcaggcaggtagtgagctgcacatttatgcttaccgtcagcacagttcagaagaccgtctgtgtcagagaaatctgcagaaatgatcaaattcgactttttctgttctgcaatacgaaatagcttctgggcaacaggatgttgatgagaagcagcccgaatatgatacgggagggtggatttagacgccattgtaagagttttttttttatcaagaaatcaaatcaagcatagactgctggcgctatgtctttatcgcaaaatcttagttaccagctacataatctagaggcaaaatacgaggtggctaagctacataacctttttctttagagtttaattgactcttgtgacttttcggtaagaacaagccaaagtatccgttgaccagcgctggtgtttgtgtgagtgtaagcaaattgtgccgagttttcacatcactaggtggcgcataatcgctggagctcaaagtagacgacgatcaagtcatcgactagcaaccacctgaggcattgtgtcaatccaagaactacacgtgaaagctccagactatagaaaacacgggagaactgcaatggatgaaatattacagttaatgcaaatatgaggctaatatccgtcaatttggcggcttcgttgttgtcaagatctggcatggcagaacgccatacagcatcctaaacccaaccaactcaatcttgacttccctccactcaagctccaggagaacagccttatggtaattaaagtgcccgaacaggtctattatgactacacggccacctggcttacatactcgagccatctccttgatggcaacggtttgcccttcacggttgacgttgtgtatcgccaggtttgacgtaacaagagaaaagactccatcagcgaatgggagctgttcagtgaaactcgctcgatgcagcacggtgtttgcagaaagtcccatcgccgccgcgttctgatatgttgcaagcggcgagtttcccgtctgatctgccttgctgaatatgtcgataccataggccggacatatggaaccacctgaagcaccacgggcgagcttctgtttgcgttcggccactttgagaagcacgagcccgcgaccacacccgacatctagcgccgggccatggaacacctcgtcgggcattgaagctaagagatcgtcccagacttgaaatttccccttgagggatgcatagagatacaaaggggtggcgaaagacgataagcataggccaagtatggagtcaagtccaaagctaggctccgatggtaagtttggcgggggatcagaggcagcgaattcttgaatgaggtttttgggtggtgaggttcgattgtcctggagatagatcgccatcatgaactcaataactccgaaagctattaggattgttcctcaagagtcgacaagccctcagtggcagtcaattcttatcaactctaccaaaccgtttggaaggatgatgttgggcgcctcacggcaccttcatccggctgtcttacgtagtccaaaaaaacaacatctcgggattggctaggcgaaagcgaggtaagctaccactggaaccgatcgtcatcgccggatcgcgtttagtaaacctgaggagaagatgccacgaatggcagcgcgtgatgaagtaaacactctgttcttccttcatctgccgacaaacggaccacacaggagacacggatatttatccacctacctggcagaaattgccaaataagcgtcagaataacagggaccacagaggtgtctcaatcccaattcccaaatacaggccagtcgtgaatgataattataagattattgagtaactatttagtaatttaacctgcttattactgcgcaaaggaagtcttaacatgcgattgactgccgcaataatttatcgaggtgactttgtagtccctgactttctgagagccacctgattgcctctcctttactccattcctctgatccacacgtagaaacgcggtctcgggtccaggctaccctaaagctcaatgacagagcaaagaaaaagagcaaaaacaggatgtgagtaatctaaacccactgcagaattttttattttattttactgagtatcaaagttacgcgatttctttagttgtgagattgtactgcttcatgaactgctcttgattagtggcataaacttggtgaacaagtcgaaggctaacgcaaacagtgccaagttttcaatgaaaggttacagagaagcaccacctggccttatagattccctacctcaactgacctataatcattggtaatttgagcaaacattgtagtgggatagaagatcggaattttattgctgagattatggtatcttattatgctattatatactataaaagttggatgtcgtggttgatcatttcaagtcgtttgattatgtgcatttggctttttctggtcgttctactatatgtagactggccactcctgctacgaacgtcgtttcgctgagtggactcagttcacactcggacgcattgccttccaagtagtggcgcgaagagaccgatgccttgcggagaggtcgagtgtttgcgagagatcgcgtggacaaaggtctcattatagtcacagatctttcatgctgtgaaattgtgaacttgactctcgatgcaagaagatcaatactgaaatgagttgttagttcttgccatgcacatccacctcatcggcaactgagggcttactatatcatcatcggaaacaaacactcaaaagtgtagataaacctatcaacctgactgactgtgttcgtagattcctgcatcgaaggctggaaggaataagtcacagcccgtgtcgtgccgatgaccgctaacgtggtcattcggacttccgtactctggagaaggtaccgaaaaaactttgaattcaatgaagcttctcgggagactttcttcgcggatgcgaatttccgcagcaggaaaaaggagcaaagaatctcaatagatgcgatgcaaacaaaataagcaatatgcgctctgttgatgacggactgcaggttatctctttcgagaatggttactttgaccctcatcacaagaatggcaagtcttgcactgataattaagacaaggatgccccaaaagaggatgaggaaaacgcgtctcgaccttcggatgaggacgcgtgtgagaatgatgtagctgtaaaaagacaggctggcttcttgaacctattccggcgaccagcgtcaatcaaagagctcgctacgaccttggaagattgcgtgatcaagtaaaattacaaacagtgacttaccatccacatcacgtctgcaaatgcagatgcaaccgcagtgttgactggtgggtgagtctgatagtaggcgtagtagcagagggcgtttgccaagcaacccgcgaccgaggagatgatggggaccgacgcagcagcgctccatcccgtgatgccgatgatcaggaatccgaagagcaagcacacgatcccgatggagctgagcacgccccagctgagttcgagaaagagcgcctccgccatggctgcgatgacgcttcagtaattgacgctgcaaatccgctcatttggcgataagactggcaaaagcttgcggaacacgatggcatggcgataaccgggtctgccattgttaaatccccactcgagtcgaaagatttctgtgccacaatgaccagggaagtcaccaggaaaaggctgaaatgggatctagggcattattgcggttacgcaggggtggtcaatctggggattgcggagaggacaacagcggtgtggatcagtacaattggcccagtggaagaagcagacacacttgggaggcaatggtagcattgcgaaatgacggccagcgtgggattggtcagcctgaatgccctgcatagacgagtggtctgctccggagtgactgcgaggggttggtcaagggggttaaggggttccccagaccctgctgaaatgagccagcagtcgtttcgtaagcttcaccaagcccagcggagtcggctttaccaattcgaggccggtctcctggtcaggacagggtatggaaatatgcagatgagacaattcggcaggagggcgcctgagggctgaaaatcgcttccttgaaggagatcgcacggctagagtgtgccgcgagtcagaaatggagatggcgaaatgttttgaaatcatcgcatgtgagcatatgtgttgcggaagaccataatgtcacgctttgaggattagccccctacaggagcttgctcaagtgatcagcagaggaaagagggtgtgatccagagaagcgaacacttggggttgggccggctatgaaactgagggggcgagacctggaaatgagggggtatggggaacgctgagctagcaaagatggaataggagggatgcaaggggggccaaggagaactgaggaggaggagatcagatgaagccagctgacgttgcaatttaaagggtctcccctcccccgcacgattcacgtttgcggtaattgccggttcgcgacaggtaacacaagctgtgatggacgcttgagatggcaagactgccagcatgtcttcaagacctgcagatagattagagatggcatccgactgatcttccgaatcgagattgttagctttaccagcgaaaacagtctcagctcgactcagggacattattgcgaccaaaatggagtgattcatggccaggaactgaatgtacttactgctcatgtggtttttaacaagtgaggaaccaactactgccggattccgcgggaacgtgagaatcggaaccgtagatcggaaagagtcatggcagttgatcccaaagccgctgctggttggtaagaaggcagcaaatcttgtacgttctgactcctgtatggaggctagttacgtgttccataatgaatccttgcgagccaacttgctcgatgcgacgggcgccaacatagcctgaacctggggggccaatcctgagtccgatcaatgtgacgaacttggggcacgtggaaactctgttgctcttgtaatgtttcgggagcggtgactaaccatttggagcttcgagctctcaacacctcatggatagcttacagtgagcggggaagacggggctgttggcgtgagcagcccatcctgcgcgagggaaccgcaccagtcagatgaacggcggttaaaagccatccttgcgagcttacctgactataagccaatagacaaccacaaaaatgtccgaggtgatcattctataggcagtaatgttcgtgaaaacgtctatgcagcgatagtcttccatgcatggaacgatctaccatgccccaggaccttgaaggttgccaaggaccattgacgccgggcaactgatattgtggaggatctgtgacggttccggtgggctgcaggtaggtgcagctgtttctagaagccttcttcgatgatgatcagacctgaccttgatccacccatctgagttaatttaagttgggaagggtagggtaatggtgcggcaagcataagaaactaccatctgcaaatctgttgttgaaacctttgttgggctttgtcttttcttctgcccgctcgtcgaccttactgactgccactgacccattccgttccctgttggacaagatgtcgacaccctccagcctgtccattacctctcgtggcaagcctaatggcaaccgtaccaaagtgctctgggccagggttggcgtacccaagccaaaagggagaagatctcgagctggtaagtggaagagatccatgccctttaatccaaaaacaaggaagtcgaagctaattgtcaatgaaggatgtattgcatggtatgtttacctattcttttttgagatgcccgaactaattgccagttgctgggatatagtaaagaagccgtatgtgatttctgatcatttacacaaaccagatgctgactagtgtttacatgacagaggaaaaaatgctgcgagacgaagccaacatgcgaccgatgtgtcaagcggcggttggagtgtgtttaccagacaacaacctcgagcaaccagaacggcggatcagtgtcagccaatggagattctcggttgaacatcttgagcatgaatgatgcatatgatagtccagggtcccatgacttgggcatggtgacaccggagtctgaggtgttctccactgatatgttggcatcatttggtagtgagggcgacttcgacacaatttggaacgatagtgatttgtttcagtatatgtcaggccaagtaggctggcttgaagctgattctccctcgcttcagtatgccaacccatggcaagatctcactccgccgtgtgattggcgaccatcgtggagcacaagtcaccaacacttgctccatcattactctgaagtgctgtcgcatctgatcgtcttgagcgaggagccaatcaaccctttccgaaactgcatcatgccgatcatatatgagtctcgagactcacctgtcttgtatgctgttttggctttctctgctgctcatcttgaaaataccgggaaacaccttgaggagagttctgttgatttctacaacagaagcttggaggggatatctgagtcgatgtctaatggcgcgagcccccaagaaaccttgattgctatcatcttacttgtatattttgaggcagtaagttgatcccaaatgaactggttaattagaactattgagagatactgacctcaaccttagctcgttcggtgcgagtcttctccaaacatgaaggcacatctgcaagactcctcgcgcttgcttcgaaaaatcgaagcatccaaacagtttgaatttaattttctccacaaagtatgaccgctaatggtatgtgacctcgaattacactaataccatcttacacaggcactgggattttatgatgtgatacattccctatcgacgagagccaagccgctactcaccccaccaggcgacattgacaataataggggttacccaaaaggcaattcacattccggtgcaatcgatcctttactcgggctatcagagacactgtggcccttactataccgccttggggtcctcctctctcgtcttgaggagtggaagatcgcggtagaggccggcgatgctttcgattccgacattctctatattgccatccagacctcggcagccactctaaaagagacactcgagacctgggtgccagtggtcccccaaggctatatcttatctgacggcaacattagtcgtcaagatggccagatcacgcctgactgcctcaccattcgcgccatgttccacaatgctctcgcctaccggtatgctgctctcctgcagcttcacaaagctgcgtatggacggccccgccaccaccgctgcattcaagagaacgtgcgccttacgctgaaccactgtatggaggtaacctcctcaaatggcccagttagcgcactgctttggcctctattcattgcggcaagtgaggctgtaacgaaagaggatagatccatggccacacagacatttagctgtcttcagcagcgacagggaatggtcaatattgaccacgcctcggaaattattctaaaaacgtggagcgatccgttcaggtcttgggagatggtggagcaagagatgggatttaccattgtttttggttagctgccagccaagtaataaagagctggagaataatacgtccttaaaattcaattaatactgaaaagtggcatgatgaaagataggcatacctacgtgcagattcattttatttatgaagtaaattctaagtagtttttcaatgctgaaagagcctgcattggggtaacatggagacggcatcggtcttaaaatgaactctatcaaccgaaatacttaagcaggaacaacaagaaagaaagatgcacgcgagaatcttattcaagtctatagcagtcctctcttacaaccacatgttacttgcaagttaattactattcttataagtgcttgatgtagtatctccaaaagtgatggtgacgttccagttggtgaggcccggagacttggcagcaccgaataagctaaacagaccagccgaaacaacaccgttgccttttggaatgtcggaagggaaagtcacggtcttggttataagagttgaccctaagttggattcacctgctgctggttaaatattgattgtctctacaatgattactggacaataacgtactgggcccgagatagaaagaaccaagattggttccaagtgcaccggcatagccgtttcctgtggcatatccaaatgcgacagcaatatcatcgacagtcatcatattggttgcgctaatgagatggagattgactgtatctccgggcttgatagtctcgggcacagagatggcttggatgtatgcctgagacgtggcaattaaagccgcaagaacagaagttgtggcgaagcgcatcttggctaatttctggaggaagaacgtattcctggtgtttttgttgcagataacaatttcagtcagacatatctgccattttataatatcaacatcaggttgtgtgtgttaccgatcgtgtgagcggcagcactcgccgtattgatggtttggatttcgaaacctcgtattcaaaagaggcttgcattctttatacattagcgtttgtagatccttcagccccaaatgcaagcatgacgtttcggataatcggctagagaatatcttcgatttgactgggccgttctgcgaattttatgcctttgttagcgtaacagcttggcagagctgcagtttgggttgaccgcacttcaatgaatcgcggctgactggatcacacagacgcagtcgggtaaacggcactgttatatttaatttatgacccgagctgtctcttgatgagatacgaatcactctttcaagcaaatagcaaacatgaaaattacgagctcacgtatgcctaaaggtcacgaggcagactgcgggaacgtcggcagggacagatcatgtgaatgagtgaaagactatcaacatttacagcgaggcaaatggtgagatttatttctctaagggatttagagaatgaggaattctgaggccccaatctctgtgaaacattccaaaggtagactcggaatatcgtccacttccgtgagcagaggagaaatccttttatggccggttccctgggtcaaactagatctgaccaatattaggaaatcggactcaagcctcgaagtaccaaccgagcttgggcaattaaaataagaagagagaattagacgagggaatttaagctatctggaggcccgccttgatgtgtaggtattttgtataggaagatgacacgaggcgatctcacatctccactctcccattttgctttctccttcaagtactaacgactcaagagggctggcgatcagcctaatcgctttgatgggcttgtatttctacccttgaattaaaaaaaaaaaaagaaaaagaaaaaaaagaaggctaagccgtgcccttgttcaagcaatcggatgaaagtaacgcgcaaacagtgatgaaaacttgcatcacagcactgaaaggcctggcaagaccccagcttcatgatgcccacatggcctattgcccagaaaagttgaattggcaggcgaacttgagatgagacaaacattgcaaagcgcaataacaaaatttgatcttgtgataaaagacgtcaataaagaatctgaatcaggttcggccggacggcatgacaatacgtcactacttctcataatcttttaaagattgatcgctgtgagtctcactgttaccattgattgtttctcatgtttgattgaatttattatttatgaattacggctggttgagacattattcggctccatagctcattaacataaaaacttccactagacctcgtacacattgggcttcattatcgcagctactccaaaggagccaagggcttgatgcgctgcataatgccctgagtgcttctagtgcttggggccgtatagtcgacgatgtaaatggaaatggaaacagcaccattctcaacgacataggtctctccctcgagagagcagtcaccattcacacaggtgttgacacctgcggcatacggcttgatgttggcccagtcaaaggttcccttctcagcgtccagcacggcctcgttgacgtgggcattgcccgtcatgcgcgtctggacgtacttgagatcagagtggttgcccttaagctcggggatgttgacattgaggccgtatccaaggggcaaaagaggcccgcccttgggtgcgctgttgatgacggtgttgacgaccttgacgcccacttcggcggcccaagtggcggggttggtctcgttgtgaatgtcaaagtatggcgtggccttgttgcttgctgagagggcaatggcagggatgctgcggtgggtcgcggcatatctgtctctctggttaaattacagagcagcatggggagaggggcgaatcatgcactcacgcagcgccagctgttccggaaagagtccagacaaaaggaccgaggttggttccatagttggggccggtgaccacaagatcgggcaccttgaagtcggcgaagcgtggtagaacgtagtctagggcaacaaaggtgcaagcagctggtgttccgttgtagtaccagatgtggctgtcaatcggatccgggccaaccttgaatgaagtttagtaagattcttccgttggagtgatgcttggctcccagattcaacctaccgatggctcccccgcgggaataatgttgtactgagatgggcctgtgaggttggcatactgggtaaactctgaccggcctccctggccgctctggggcagagctggggcgacaatccacactggcaaaagacgcagttagcaatgagcaaagaagcatggcaaaccaaagcaatgaattggtctccttaccatcatggccatccttcttcagaagtcggtagacctcgcgcagatttgctgagccaaagccatcatcgttattcagcaagatgtttagagcctgcgaggttgtggcaaaggcgagagtggcaccggcgagaagactgctcagacgcatgatgggcggattggaactggggatagttgagggaggtgaacaactaatgctaacatgacaggcgagccaccgggaatttaagcatctttacaaggctacgagccaagaaaaatcgttccgtccgatccaaacctctttcctggttcggttgggctgtttgcttggttatcgcagatccacaagatcctttgcaagcgccgccgaatagggcaagtggtcgcgtgcggactgcgccgatgctgacgacaatcgatgataagagatagcaagaggccggggagagaaatgaaatgctttcaattgatccctcggccgacgagagagtagagcggcaccggaggactggggcagggatgcgactgtcttcactctgttccttgctggccacgttttcttggcacctttattaaggtccataccacctcatgtcgtaatggccgatctcatatgtgaagacggctgactacgagcagtaccgaccgtttgtacaagtggcgagagccatgagtcatcaaaaactacagtggaacaaacttgaatactgtattcaggagattcacctatttaaatcaagtatagcccatggcatcacctcagtggatgctagcatagggtctgtgaaagtgagcagcaggtgagaacgtgtgttatgtttgtcaactcatagatgcgcgtgtgaacacgcgtttgattccgttcgacgcgactgtttgcgtttgcctgggcactccttgaggtcatccgcctaaaaacccccagtaagtgaatgcaaagtcagagattccttttcttctcttctccatcaacacattgccctccacactttcactccacacgatcacatcaatttcttccaacttcaatctgccccaggcagttgctccaaacactgcagctatttgagccaagcacttactcaaccttccatcgcactaccccgactgagaatctgcgagcatgtctgagccagacagaaaatcccgtgactgctcacctgagccaaacaaagcttcgagtaagatccctaaactacgtatccgacaacaatttaggccacatcactaacgacgtttcgaacacagccctcgagaacgacgctgtggcctcctgcaaggcgctcaacctagactgccagtctgacaacaaacccaacaacggatcgatggatgtttgcgaggcagaatggtcaagcgacggttccgacggttccgacagttctctggacagcaggtttgttgagttcgacttcgacgcaactcgacccaaacctttgggatcacccgacggccagtgtgagcattgcaagactcgagaagcctcatttctatgcttcttttgcggtatcggcgaattctgctcacccgcttgttgcgagctgaacatggagaagggcaagcacaagtgcgtgtcgaacgaaatcacgacagcccaaaacctcatcgacgccattaaccaaggtttcctcccccgggatcgccagactctagacgactactaccttacaccccttgttgcctctgacgacgatgaggatctcaaaatgctcatcggcatttaccgcaacctcggggcaaagttctacatctccaccccccagcttcaccagtggaagcaggcgaagcaagtcttcaacaacatcgtccggttgcacaaccggtatcctaaacgggcacctgcgattcatggcgtttggctcaaaagtcatagccacgtcttccttgaggaggataagtcggaagttgttgaccttgatgcctacctctaggctaacgacatgaccttcgatccgttccgtgcaactttcatgcgccagatgtgacgccacgaaccttgcacacaaagttttgatggagagtggtttcaatgcaccgcggtgtattctaaatctctctctctctctctttcttttggtgtggagaatactgccaacagggcttggattgacggacggatgactttcgctgtgatttcactgctcgcaagtgctaacctgaaaccatgggtggaaatggtgggaggcgcatgagtgacctagctgggacaaactggacgggctaaagttgcacgagtaggaggttgggatggatgcgcacgcggttctttctttggcattgaagatcgaggaacatctatagcctccgtcttacttgagtagacttgcttagctacgtagtcaaagataccacatgtttttaattcgccatcccatgaaatcctcgcaagggatccacgcctaattgtatcgaaatcaagacttggagtgacacactgctacagaatgctacacgtgctggcttggaggcatgatgagctggcggcctgaccagcacgtcctcagagcaaatcggtagccaccttggcaatgatatccaaggtaatcatattcagaacttccttggtgtgccctcctcgaaatgggagtgctccctgttgtccgtggtttcacggcgcggtttcaacacttcgtgccccctactgtaggctccggcagaatgaagtaggggttcgactggattaccaaggcactgactacatatggaagaagtctcactgcctccgtggcgccgtttggttcctgagaagcgggcacaaggcattggagacatttcagtctagtttgcgctgacggatcacaactcttatcacctatatctattctgtcatccagaaagaacgccggaggactcacgcgagcaaagactggctttagctttcatggtcttttggtctcatcctacgctcacccttttgcagggaagcaggagaaactgccatgccccggttggttgttgttttggtaccatcacgttagagaggcagttcaatctgcgtctgtctttcgtccaaagggattgggtaaattggacgacacccgggtaataagttgatgaatgttggcgaagaggggccactgcgacacctcaccctttggggcttccgcgggagtaccccattcatgaacccttcttccacccggccccagatgatgcgcatccgattctctggtggtatagtcgctgaatggcaagacgagaagcacgttttcgtcagactccgctacgccctcgccaactgattgactaggcgaggaacggctatctgcggatgacctggacgacctagacgacccagacgacctggatgtgctatggtagtggaacgcttccgacgtcttctggtcccgttgactccagcccgacgggaggcctttctctattggagacaccacaatcgaggctgcaccgcgtttatgcgttggtgtgacgcaaggagaagcgactgatacgggtgagccgccacgtgaagagactgagcgtggtgggcgaaagtagaaccttgaagggatgggagtctcgttctgaggaaattgagcttcaggcccccactcctctccctcacggtcaggcacatttaacaatatgccttgagatgttggagaaaggttcgttcttgctgtttgccgtcttcggagctgccggaggctgtaaacatcggcctttggggcgttccacctattgacaagtagcttgacaagacttatcgcagacgggacgaagaaacctccaagcagcatcccggcgtgcaaagctagaattgcgcgcccgatagttgttttcgtagccgtgttcgaagcaccaggaaggaaggcgaccatgagccccgtggcaatgagcctaacaatagccccgatggtgacgacagatccaaggggatgcgacttgagcaagtagatacagcccagtaaaaccacttcgcaattgcaaagaaccaccagctgtgcagcgccccatttctgaagtccgccaaccaccattcctctgatgaagagcaatgtgaagagcaccagaacgaagacgtcatcgtatgcggttggcgccggggcatcgcctgggagcaggctctggtaatgagtagatttattcaagagcagacgcccaagactccggggcgggacctggtacagaagccaggaaaagagcgccgccaggtagacgatcaggaagacggcgtagacggtgtgagtccgcggaagccatatggcgttggcaagctgatagaacgacatggctatcagcggcatggtgaagtacgagaaaaccacgcgaagcagagaggcaaatcgatggcggaggctgctgcgaacatcaggtgttgcctgatcctgcgaagtgcactgcggtttgcggagaaggcgaaggcattccaggatgacgccagcgcatacagtgattatgaggatggtgaccagcatattgaaccaggtatcaatcgttccaggcgtagcagcaatctggtgcattatctcaagcccgtaggtgccgccatacgtgccgttgacctcgtagatgccgtcgcgaacaccgttatatgcgagtctgtgtgtgattggcccgctgtggaatagagagaaccaactcagcttgctaacggctgggcgatagaagccggggtaggagatgctgaggcctccagagaggaagacaaactgcaaatagtgcagacaatcgccaaagagcggaagtattggccgagtctctgtccgcagcagtctcacgccatctatgatgtgttctgtcggttcgtgatcgtacaatgagtcaatcgcgccgtacacgaagacaaatatcaggatcgcgcagggcccccatcgtaggacgcgagatgtgacgaggtcgatctccggcgctatttcgacctgggaacaggcaaactggtcggcggtttcgctgctggctatttcgatgcgcgtatggaaggtcgagagggggattcgttcgatgttctgggaaacgttcgttcggagcaggcgcatgccgtctcctgcccacggcacggattcgcaagtcgtatttgttgtcaattgatccgagactctccatcccagaccctcggtagtcagattcacggtgacagctgccagtccatcgcattcagccaccttgaccaagcttgcgccttcgatgctgagtgtctgtccgtgtataaggggtctcagtgccgcggtgacgctggtcaataggcctttcttgctgcgtacattggcgcatggtcgggattcaacgtaggcgcccaggctgttggaaacggctatggcgtgaaacagcagccatagtagctggccatggtgcatagtgaatgatacggaatgaccgcgagaaggaggacaatcgctgctgccgggtgggatggtgcaaggaaaggagggttttcgaccgagctcacattttcaggcgacagacgatcgttgcgcaagtcagtataatgggcagatctggactggactcagcctcttcaagcgcgcacttaacccctgccctattctagtgctccgatgccccattaaaatcaggggtttccttggcgtggccccgtcaaacgggtcacagtcaaagtcaagaacagtgttaaggcgtttcgtagttttgagaaccaatagtacatattcaagggatggcatgcgaataactgtcaatgcgtatcatttgataggcatgtctcttagttcttttcgtgcttacgactgcttttcatcttgagcgttgacttcttctcgcaatgttgtgttactctgactcgccatctggaaaatttcgaggcacaccagtctcttaggcgaaacactaggcattccgattatggggcggcatgacgtagcttccagatgccgaccctcaatcaattagatatacgcaaaatcttttcgcctcgggattactctgaaatagtaagacgtgtatacacggttgcgtagagaggcgagttttatctatcaactaacatggacctcggcatggctggatgcatgttctcggtcaggttctgggtcagagaagccaaaattaacgataaattcatgttccagggctcgctcgatgaccatgagatgtttagaacagaaagagaacgggatgttgagatagatgagggtggttcaacctcagttggaagtactgattcccctttcatggattattcgttgcatttgagacacgtaagagaaaatagaataaagtccagaacaatggaagctgccagagcgacaactaagcacaatgaatgtgccattaagatagtaagatactatattgattattctagctctgatctatgttatgagtataaattacctaggcaatgtaacaaaaaagtccaacttctggtcttagtatcttaccaaatccaagatagctcactatgcaaataataaaactactcaaagttaccatttacagaatagtatctggactagatctcttatgcttacatcttctctaatattaaaacaagagaaagccctccaattgaaggtctgaatgcggctcgcccgtgaataccggatcgccctcaaagagttctccaaacatcaagccttccacgaatgcctcacccaccagacgataccgatccccaaacggccgaagaataaaaggaacatcagctcccgcgataactacaaccacgtcccccggcagcgtattgaccgtgccaaggccaatccagtcgtttgttgttcttaagacgcaccgtccggagagtgcaactaccatggcattctgcgccactctgtcctcgtccaccgttgtctctttttccaccgactcatcatgcctccctgactgatgggatgcatattttagcacagctctagaacaggagtcgggcgctggaaccccttcttccatccacggcaaataagcaaagtggtcggcaatcatcgttctccaaatggcctccttgagtggtttaccttcgatacaaggcactataggtgtaatttcgtgatctttgtctgtcgattcaacaaatttccattcccattccgcaggagctccttgataactaacagatacgttaagctgttcgccagtccgtggagctgagtcaagagctggctcatagatacacccagagcataccaaggaatcgtcatttggtaccacatgcccattttccgtataacagtcgtctgattccaggcctgcttgttccaaaagcaacaatgacttagccttttccagtcggacccagcttgatgtttgattatggggtgttggccggttcgctgaacctgactggggtactgctagctgggaatatgccggcgttgctgactcgacctcgccaacaaagagaccaaatacatatagctcattcctgtctcttttcataactggagggagtcccaatgacgcgttatatatacttccgcgccccctctgctcttgtgcaaaaagctttaggaaactaggctccccgcatcggtcaaagttgggaagccaagacggccacgctgtgtccgggtcagtatggaactgcaacccagcttttgacaaggtctggaagccttgaagcccttccaccgatagttcaaatgcttcagcatagacctgctggataggcttgttgtagtcgacctcgattcgctttctcgattcatcgtctgccagcgccaagaagccatagatcttgtcccttggttcggagcaaagacaaagtgccgtgtcctctagcaagggcatgaacggaataccaccgatgatgcccttccagtgatgatagtgttctctgatgtggtatgtgacattaggcgtgcgcggattcaagccatcagcgccctgaatcttcgtgcgcagattttgtggcatgactcgtcctttgccttcgtcctcatcgacgaagaactgatgaaggtaccccaaggcctcgataaatcggtcccattggaggacactattgccacagatcaccagtggtgaagtggttggcaaagcaacctcttgcagaatccatgttctccgaaaccaggatcgattgctgacgtccacaaatccctgagcaaccgtttcaatgtcaacctcggctgtttcagcaattgttcgtatgtcatcttggctttgcatgaactttggcagattctcgacctgctctgagattttctccaatgcctggaaagtcttgtcaatgagctcatccccatcgccaagccatataattaccacacgtgcggtggagtagacgtccttcatcattggtactaccaagttcttttcgtttgtatcgccctggttaatagagattgcatcagcccaaactgatatcggtttagaggtacagaagtggcgttgcagtctcttcagtccatcccacaagttttccgtgatctcaaatgggtaagaattcaggtaaattgtgtgggggacctgggatggtgaggtgttgccccaggtgtatgacaatgcgacatagtcgttgaaggttttaagggattctgtgaatagttcggctttgacatcaccattttctggaccggggtagatacgtatgaagcgcgtttccatgtcctcggcacggatcaaggcagtcttgtagacctgatgaaattgagggttagtgtcagcagccatttcaagtttttaatatacagtctacaatggaagaacccagctccctcttcgttggaatatgataaaagttcacgggctgagatataagcatgcctggaggcttgggcactctcgagttatctatctcacggtaacataaactagattgagagtggtattagatatgaggggatatcaccttctgccccgcacatcttatcctactctcctaccctagagcttctttaatcagaggcacaacatgataaagaccccagtcgatctagacaaccaattcggcgatgcacaacatctttataactttaaactactccagaataacaagactatataattatacggactataagaatcaaaaaaccctctcgtgaatcttgtactctgtatcaagatcggtagctgttccggccccagccgaaagggtctaatactttaactttagtagaaccataattactccagggtgagggactgggtgtccctcaggattgtttaccgtagtaagacttattgcaaaacatatagattatagttcatgagccgtagagagcagaagtttgggttcataaatttatctttttgggattaacactcaagtctaaaagtcagtaagacgcaattatcacagaaagattgatctttcatacaaaagattgaacaagaagacagagaagatagtaaaaacagaacatgttatatttcgcaattgaactccagctagctaccaccaaaagccgagcaaataagcatgtaagcctaacctaaaaaccaaccacaaccctcagagtttacaacaaagcttgtctttaacactccataataacaactaaaccccacaccatgcaccagttcgcagccctattcttcttggattccccaattcccgacagcatcctcatagagagcagtatctcaagcctactgttcccgtcttccaccaatggtatcaaactcgattttctatcctagatagaagatgaggaaactttgggcttccgccatgttaacatgaatacgaacaattcgcttgccgttgaacttgaggcttattcgttcaactgattgcccccatacagaatctttcatatcctgataaagttttgggttgcttgtgtcgctgagatcgaacttggttatccgttcgggtcttggttgctttttcgctttctttgccgcacgtcggttggcgtcttcccttatcttctttctctgcttgttccaggcatcgtctgacatacccttcgggcgactcgtttcttcctttgtgagattttccagctcaggattcattgccttttcaacctctctcatcctgtttgcggtgtccccttcctgaataaactgaacgcgaatgacttgcagttttgcaggatcaactttttgtacggaattatacttatagccggccaagaggagttctgcaagagaagcctttttcccattgattgtcttatcagccttgttctccgccgatttgatgacaagtttggcgccttcgtcagcaaacccaaactggtcaacagatggttttttctcatcgaacccagatgacttggtaatatcaaacatatgataatctaccccatcataccttgactgtttatttatttcgggttgcttcaatgtataaggataatcgggatcttgagaattgaatggattctgcgtatatttgtattaatttctaatccaatcggtaacagttgggaaggttggtaatgcttacgaagtccaatgacttagagtcccaattcggtctcttgctgctggatgccgctgatttgccgcctgctggctttccgtctgaagttggtggtttcccagctggagtcggcggttttccagccggtgttgccggtttcccagctggtggtgctggtttcccagctggcggtgctggtttcccagctggtggtgctggctttccggctgaagtaggtggttttccggctggagtagagggtttgccgcttgatggcttattgctcaactgattttgtttctgatctttgtccccacgtgctttgatgcgagcaagtcctggagttctctcatcaacgtaatatgccactgtagaagtcccatatccattcctttgagcggttttaaggtcagttgcatattggcttcttatatgtttggatggcatgcttacacgttgaatagaataccggcctatgggagccccggccgtttgttgaagcccggaaagggagagaatgatagctgtctgaatataagagagccgcattttagtgaagtggtttggtgcttggagggataatcggtatgactgaaagtggaagattgcttgatgtagatgctgatttatctggatcggaacttggcttgagagcttttcttctagaatttatattccatactaagcggcaagttacggagttgtatgcaaacttcggcgtgaagcgatgaacatacgtgattctcaatcaaccgcatatgacctttgaaatagaatactgttacattccttaagttggtggtcgctctattttagcaactgccttgtgttggcggtgcgctggtatccaaaaagggattctctagtcccggaccgctcttttcctaacagctgtgttgcattgggggtcctctcaagctcatgaagtctaccttttgttggtggacgcctcggattccgacaaactcctcgtaccctgggtggctacaggaccaacattactgcacgttggcgggcaacacctgcgggccggacctaaaaaaaactatctttccatttttgatgctccttcaagaagtttgaccaacaaagtatccattcagctgtacgaagcagctctgttggcgagcgacgctgcagagcgtggcccccaacagtggagagcttagacatgtttaaaattatacacaaagcctgggacctaggtaggtaatatacctagcgatgctgacgtggcaaaaattgaattgtcaccaccaacaaatatacccggccctccctcgtttgtttacatttgttcccctcacacatcttccacccgtgcgtgttgattgggacacaatggaagattattacctacccaatctcatcttcgaattccctagtgagatcttgcaaaggattttattcttctccattatctcacgcttgaaatatgacgaagaggagcctgtacgtgggacctccagagtcctgagcctccgacttgtttgcagtaagatttgccgaccctttctggaaaagaaaggaaggcgaaattcactgatgttttatagagagatttgatgagttgtttcaaagcgcgctcttcgagacaagacttctggatgacatacggccacatggcagccctatttcaatgtcaggaactttggagtactggccttcaaaccggaagccagccgctcacaaactatggcattcatacctcgtgtatagggtgcttaacgaagttgaccccaacgtgaagcggtatgttgaggttcgggacatagcaaatgctatttgctctgagactggaggggaccttcttcaaacaatcaaagatctctgttggctcggtcttgcgcatcaattagggaacgcttggcctgtcccacccgtgcgaggttggtacgggccagatgcactcacaccaagaccaagcccgttgaagaacaatagtcctgatgtgagcctacttagcgctgccgcatatcttggttgtacatccttgacaaaactcctgctcgaacgtggcaacgatccaacagagcatgacacgctcttcccgtgtcccatggaggccgccgctctggcgggacaagttgctacactgcagctttgccaagccaacgttcccttgagacaggacaagtatctttttcatcacccgttattggagaaagtccctcgcattaagggaacatttcctttcgcaattgctggcgctgcctcaagaggggacatggacgttctggagatagcacttcgtctcgatggcactgcagaggatgtaccagcccatagaggagtttcgtttgaggttttgcgcttcgctaaaacatgggaagttttctcgaaacttctgtctttcttacctcctgatttcctagagaagagagaaaaatctaccgagccccacggtagtgaacttttactccattttgccgacgtcggaaattttgagattgccaagggtctccttgatgctggtgctcatactcggggccatgaatggcaattaggtatacatccactctggattgctgccaggcacggatacgaggacatagtagacctcctgctagaatacggagcagatgtcaaccgggctaccgtcctctactgcagtacggtgggcgctgcggtacgctcgggcaatatcagccttgtgaagaacctgctgagcaaaggaggaaatttcaaaggagaggcaccttgtggtgcgctcgtagtggagaacgtccctatgttggaacttctgctggatcacttggatgctggggcaaatatttctatggttctaatccgtgaactacttgatttggcgtcagaaaggcacttgtttgacatgtattggtttgtcattaaatatacaatggaccacgtggacgttgaatttgtattcagtgattccgaagatgaagatctttgagtgggatacattttggtcctgctcagtgtcgggtccgtagtcagcattgaataaaggattttttgacgaccattgggactcgctgtcacgaaaatcactcctgaacacaacctctgttaaatctaagcactaatgtcttcttttaatagtagagatcaattgtattgtcgctgacttataagtacggctgcaagctttcctccagggaatcctcgtatttacaccctcaaaagtgtccctgagggaatgctccctttataaaatttgtaacatcgtcccagagctgctccggtcgctccagagcagcgaaatggccgccacccgaatgagctctgtaaaacgttaaatttccaagatctctagcccaacgttccggcaccccggtattgtcgtatgggaatctgctgtatcccatcggcttgctgatatatggggaaggggtaaaaacgggcgtgattgtgttggatgtctcgcggtacgaatagaagcttcgtgagattgtctgcgtgaggtggtacatggacacgaactggaggatccggtctattccaagaggatgagatgggtcagtccatgccatgaacttctcgccggtccaggcaagaagaccaactgggttattatgaagggcgaaacccagagtggagggcttggtcccttgaagaatggcatatgcctgttgcgtttcgataaattcttgggaccgagcaagaacctcacggtcttgtggggtgatggtgctatcgttggtgactggcggagcggaatctggcttgatgcttgggatcatgttcaagtgaatccctgtcgcttgttagcaatcttccaggcgttaatttctgcaagatatctcacccttgcagctctctgaggtcatcgccaatgtccgggcaacaaacgaaccgatatccccgccctgtgcgatgtagccacttttaaacccaagccccaagagcaagtcattcattaaagcagacgtatttgcagttccccagctgctctccggggatggcgctgaagataaagtgaagccaggtagtgatggcacaatgatatgatacggactagacgaggcgttaaactgtgttttgatcacgtcgagaaggtcgatgaactcgaggaaagctccaggccagccatggaaaaatgcgacggggattgcatcagccttctgcgagaaaaggcccatgaaatgcactcccatcgaatcgccggccggagtagtcaaatttgcaatgaaattggggtgtttgttcatccgctcttgaaacttcggccagtcaaacgactctcgccagtaggcggtggagtgtgcgacccagcttgcattcacaccatatcgcaagtcggtttgggtattctcgtaagtcagagggaaatctcgtactcgtgagagatcctcctgtaaagatcgaagggattcaggagggattgttacttggatttcttcgatagggattgtggcggacgaggggagagtggcccaggagcctgctgcggcatctatagctgacgccaagaatatagctttccaaactgtagacagtctcatagtgggcgtagatttggttcatcaagatttgaatgtttctctttttctccagtatcatcatctgtgactacttacctacgatgatatatatctaattaattgtcgccgaaaagtcgccgtcacttaccacatcgtccggggacaattttaacgtgctgatccttccaacagaagagggagaatttattggctaggctacgaggatcaagtttccggaaactttgatcttcaaaactcaatccgagcctaaaatatgatgtcactggctcactgccattcactgggaaacgcgcccttccctacgcaatagccaacccgcggccctaacattgaaattttcgtgcagttttcaaccctcttcccaccaaaggattcactggaatagcaccaagctacttgtggaaagccatccctagctatggcgcctgtcaagatggacttattgtatcatggaggggatgactgcgggaatttgatcaggcatgagcgccatggattacatcccatcatcctccgtgacttgctttctaagctgtctttccgtgtgaatgaaccacccaagcagccaaaatctcatatcgctcaaaaatcggatgggggggctgcttaaccgtctaccttgcccgtgacatcgagcaagagtaggttgaccttggcaacttcgcttgatagtaagagtttgcgtatttgatcacctttatgctccgcaggagataagtggcttcgaaagcttgcactggaatcggaaaacctcttaagtaacgaacgagaatcctgaaaacaccacaacacaaggccaaggcaagctgcgctctaaaaacatcatttcactctacgacacctttacgattgaaggtccaatgggataccataaaactctcataaagaagccatcatagcgttctacagtgccccaagttctgagagaccttcttgctagtatactctaagcccattaatcttaaaatagctgaatgcctcccctattgacgatcttgcctacttcagcatccctatcaccttcaataacagtcacaagaagctttccaccactcgaaggatgcccagcgccgctcctggcttttgttgctctctctcctccaagctctgtagcgaggaaacctggttccacacaccacaccttgaccccatcctccttcaatatccagtgccacgatagcatcgccatattcagagcggtcttgctggcccggtacgagcttgggagatacgcacctttctttggccagccagctggaataggcgggggtgccggataatgtgcctcgctcatccgctcaagactggccaacccgctactgacaaagatcagtcgagggtcagaggatttgagcaggagaggagcaaatatatgggtcaagatatttggtccagacacattgacgtcataggacttgttccaggcctcacgcattgtgatatcgccaaacacaagttcagcatccaatgcgattccttgtcttctcttagcgaacttctagagccaggatgcggtatttcaggtggcgaactaacctgcattgttcaataacacatcgatgcgtccatgagtagcttgaaccgaatcgaaagcctctgatatcgactcatcactcgagacatcaatctggagcagctcagttgtgctcttggtgtttaaagcgacacccttcagtgatatcagagcctgtttccccttctgcagatctcggatccccataagaacatggtaggagcgatctgactgaaggagagcctttacagtctcacacccgatgccggtattagcccccgtgatgagaacaatcgtctggttggtttcagccattttcttttttgaggcaatggtagcagttttgccgagatcaaggtaaggaggagattataattaaataagatgccgagatgttagctagactttgcggcgaggatgcaatacttataggctgacaagaagcaggtcatgggtgcaggagtcacgtccgaaattcctcacaccagccactacagtctcggtcattctttacccctcttcttaatagataaagcatgtccaattagaactgacgttactcgaaggaatgaaacgcatgtaaaaatgggtggttattctaattagttctagtaaggggcatggatgactatagcattttggtactttggctaaacaggaagttgagtgagggaccaagcggactatctgacgtgttcaatctttgcatccctggcattgtgtcaggcgccatgaattgataagacttattgaaaatcttgtatacgagtttacactcaatgaagcaatcagtgtctgaaaaagcaggcaagcggtcgtttgtagggttatgatttatgacaggctagggcataccaaattcatcgaaaaattgaacaacgaacgacaatcaacatgttctgaaattaaaaagaccggtattcgttggactcttctttagaaggaaactcacgggtatgagtgggtaccttgtaggtttctggacatccaattgagggcgcgagcttgactcacagccagacaatccaggagccctggtggcactgctcgtagttcctcacctactcatgggataatgcacattactggtgccccccgtagctatagctttcttcttgtaagccttccagccctatcgtgctctgttacctagagatatattgtcaagtaatctgagaattagggggggcttacaactgggcgaggggctgtcggaaaagtagacaccagtagtaggcacctacacggcgaagaactccagcatgagtcttagatcatacagaatacttcttgttctcgaaacattgaagatacctcttcaacagggcgatccaatatcaatagcaactatccaacattttaagccattccttttacatatgatagtcctaattggcaagtcgagacatccgaaaaacaaatacccaaagaacgtcattccctcatttacctgtaaaagttctcctggcaagcgatttgcttacctgaggatgtcgacccaacctcaacgtctgtaacgacatcagtctcctttgacttccgcggcaagtcgtgctgcacatccaacatccccgccttgttccctctcaatttcgcctcgtcattgtctatgcttcgcagcacaatagcatccgcgctctctgacgcaaagggcccggccggcttcttgtggtgatccgactgccgaatgtaatcctgacgcggctcacgagactgatcggaactgccttgggctctcaaggccctgatgtatttcttgacgaaggcgctcaacacgggagtggaggcgatgatgatgctgccggtgcactcgacaacgttgaggaagaagatgggtatttctccccagaagtcgcggggttggaagatgagcaacgctcgtgcgcacgcaatgccgcagatactaagagtgttcaagctcagtaaggaatcctcccgcctggactattgggctcttcgatgcttacaatagacctccactaaatagcaagagggtagaaatcttctttgctttggggagacgcagtggcgcaaatatgatcacggcgagtactacaatggcgatgtccacggccgcattcccaaagccaaatagaatgaagaaggctcgccgtgggccacacttggttccctcaggtaagggttctttgaatacagcacttacggggacacagcctagtattccgccacccacgttaagagccgtgtagatggccgtgaagcctatgatggcggtcgttgctatgtggactccatagctgggcgtgagtcgtctgtacacaagaaggagcgagatctttgggccggttgtcgccgctgtcgagaagaacatgccagtagtttgcaactagagataaatacgggtttaacatgtcaggtttgactatgtcggacacattggaaagacaagcttacccgttgataatcgttaaagtctgatctcgggacctgccaacgacgatgtccgaatccgtacgaagttcctgtctcacagacctgtttagaacaaaggcatatcagtctgaagtagagcaagggtctcaataactcaccaaccgcgatgaagcaaaaccaaactatgcaaccaatcatagcaacaatgatccagactagatcttcaggttagaaactacgccttcacttcctagtgaatcattcccgtctcttacagtcatcaccctgaaagggttgtctctgctcacggagcttcgtgtaggtgcggatcacgacagctgcaagagcgatggcgttggtaatgataccagcagccaggatatttgggaccattgtgaaggtatcagcgaaccgatcttctcctgctggaggctctgccaggtctgttcattgccatttgatgattagtcaatggattcagatagttctgatggttttaatgccgggtttggcgagacaaaggggatcaagctcacatatgatgcctgtcatgttctctggcgacggtatggtgatctacatttcgaagaactttcggggatcaaacagctggagacgcggggatccactgcaaggtatatataccaacatgagatggtaagatggtcagcattcctccttgttaatctctttccgctttgatctggggctgggttcaagttgtacgctaggggccgacagggccatggggttgaccgtaatcttcacaagagtacggaatcacggacgctctttggacagagattggagcgtcgtactaggttaactgggggatcctggaacactacccaaaaatgactaccatcttgccctttgaatcagatcatagaccctctatttctgcgacagtcttctggggccctcctcgagaaaaggggaccgctaggatatgtgtcttagctcatgggaaggggcaatgatccccggttccccatgactcggagatcatcctccggttttaggaataagcgagccgtttgcacggaactcgcttcacaatctgtttcgtccaccgatagttgctactccaccagctgggttacaccaaagtaaatttcaaacaaacgatcaagggttgtatcaaccatggcagatgatatatcacaatctacaacttctcggagtctggactttgggcttacaatatacccctgcctcgccgtagagctagctaatgtaagcaaaaaagaaccgtctcaccaagcagctagtcaagatatggccgagctcaaggaaataaagtcacggatagtgcatcgttcagccaagttttatcccaaggtaccaaggaaagcgattatttgtatacctgttccagatagagacttgtttaataatattgggaaaagcttatttgatggatgcctcatatacaagtgccggtaaatgcccttgcaaggcgcactgctgttcctgaataggcagtttcagctggtggtgaggctgaatagttcgaaccaagtttgaatttccctcctccctagtcgacctaattttcatttcctcaccccatctctaggcgaaccaccagctccaggatggacgacgtaagtaacattcccccttgtggttggtagtttctcatctaaccaccaaacgcaggattgggatattcccacggtcagcgaggcctgggccacccgccacgaccagcgcgggatacggatcctgcttctcgtcctgcttagccgtgtggtctggctgatcatccaaaccgtattcttcatcggcaggcccctcgcccatgtctggggccgcctaccatggtcctgggacaagcgcagagctcgagcctgtaagcgctacaacaaacaacgcgaggactcctttgccaagctcgtccaccgatcagcatcagccggccccattcgcgtgtgcaagacaggcgcaggtgcacctaatgccgatcatttcttcggtcgcttcccagctgagatccgtcgctgtattctggagcatgcgtttggccagcgcacgctgcacatggaccttgcattcgtcaggccgcatctagtgttggatgagctacagagcggcctagaaacagggcatgcaaggtttaaaagaaggcgctcgaccgatcttgactttggacaggttgattggaggtggctcggctgtgtttgtcatcgttccaagccagaggagcagccactctccttgggcaagcttcgaagtgatcctgggagctgcgccagggatggtcatagagagggctgcatggtaggcgaaggcgaatgtgctcattggccgggtgagtggcctgggaaatgccaggtcggagctctaggctggctgttgagttgtcgtcaagcgtaagttcttgcttcccttgtagccactcctttcctctcaggttatttttctcacattttcactcccgcaaagatatatggaaggaatggcggtgctttacaacaccaacaccattcaaatttcatccgaagttctccttcgcggcctgcacgaagtgcttacacccacagtgctctcgagcatcacctcactcgaactcgtctggaacccgagactgctgcacattgtcaaagtcttcgaaggcctcgagcctgaaaaacagccaacacgccagatgccgccaatcttcccctcgttgactcaccttcacatatgtctgacgagcctagaatatgtaaccattggtgtgggccaaggtgatgggatgcaaatccggaccatggaagatttggcggaaaacatgccgctgagtatagatacgctggttctcagggctgcaccagctgcagcaaacgttactgtcagttatgccgaagattacctgtggttcgaaatggtgaggtcgaatcacataaggagtcgggggatcgatgaaattcgagaccgggaatcccaatatgaagggccagagttttggcgtgagatacctgctcccagagccagcgcgcaggaacatactacgcctaacatgttggaacttggtgaagggattaaaacaggccgaggatattggatacattatactacatatggtcatgggaagtacaccactgaagagggctggactccttcatagatagagcaagtacatgcttggttatttgcccccttcgtcatctgagtcttcgtcctcgccatccgaatcctctagtgccgtcacactctaccggttctatgaagacgctatggaggtaatctctgtcacctgcacgccagaggacactccacgagcaggcggctgagatgagcttgtcaccactgatctcccagggctcgcccagcatagtaagtcctcgcgaccttgatctgaatgtgtggaacacggcggattatttcaacaagcccgttgatcttttcatggtcatagttacttcacgggttggcaggaaattttctgaacgactttcgaggtaggtcattgcccttgcacgactcttccgagccaagttggacattccatatcgcagagttcacgcgggggagagctgcgccatggttccattcgtgacaaactaagtcaaaggtgcacaataaatcattttatagaatttgtgcaaatgattaattcactattagtttatccattgtgaattctatgttgaacttcatgcggtggtcttggtgtaccacgcgctttgtctaacccgcttgcctaatcccaggaaaatcgctgtcatgaataaacaccacgcggtggtctctctatccaatcaccccgtaccgcattgagttcttgctgtggcaacatggcattgaagatgttaccgctctgtttacccttcccatgctccatcagataatgtccatcattccgccgggtcgtttcttgtgtacttggagagctgtcgtagcttttggccgtatatcataatgacgacaggtatcggcgccagggcggcgctgaccagcgatataacagagaatgccctcccaaacccatagttttccaccagcggcgtcgtcgacaacggcaacaacgaccccatgagacatctgagcacgatgagcccagtcatggctgaggcggcgtacggcccaaaggcatcaaccacgtatgccgataaggggaggaaggccattaagagtatcattcccatcgaggagaaggagaataaaaagacccatagaggcaggccaaactcagcactccacccatagaggagcaggccaaagggggccaagactgcagccagtatcataagtggcagacggtactcaggctgcccaaccccgccgtttgctttggtcagatggacgtagattcggtccacggacctgttacaaatgaacagaccgatgaatgatccaatggctgcggcgattgttagtaaaatctgcacgctatcgaaggaaaccacactcacaaaagctcaacatcgacatgcccgtctgtgatgacttcaagccgtacacatcttccagaatatctggcagggttgtggtcatgttgaaatagtgagaaaatgtaagggacccaaagagggagatcgcaacgagaacaatcgagctcttgaagatcaggaagggtcgaacgatggactccaaagccgcctcaggcccacgagacttggagttgttctgggctgcgctttcggcactcggcgagccgctcagtttcctcagtcggtgcaccttacgtgcaagaatagtcggtccgtaggtttcccggaaacagagcaagaccagaacctggcaagtagcgcacagcaagacgctcatccaaacaacccacctccagctcaaggcatcggccacgtatcctccaatagcaggcccaaccgcgccgccgatgttcggcgccagcatcacaaagctcatggcggatcctcgcatgtcgggctcgaaaatgtcgccgacaatcgccggtccgaggacgtttgacgtaacgaataggccggacagaacccgagaaaggatgaactgcggcgtggtctgtgccgtcgcagccaaaacagccgcggcggtgaagaagacgctgcagacattgaggacgggataccggccaaacgtctcggagaggggggcgatgaggagggggccggctgcctcgcccaactcccagatggtgacgagcagcacgctggcgtacttgtttttctggccgttggagaggtcctggactatcctccccgcgatcgggactggggagatgcaggtaaaagtgctagacgagagtggtcagcgaggtgaatggatggagtggaagtcatcaacaggaggtaatgcgagcatgcacgcggacagggcgaagtgcaattgggcgcttacactgtggcacccataaagaacaagatgctaatgaaaagccatttgaatttcagtggccattccaaaggattttcagggtcgcccttggcaaactcgcgctcctcaatagtgcggggatcggtggtgacaacctcagctcccagcaaaggcgccgtttcttcaacagtccgaggatccatgggttcgttcgcctgccaattctcttggagagtcttggaactggtagtcagaactctgcccttactattagcaggatggagaataaaatgggaaagtttttgagccattttagatgtggagagcgaggttgcagtgcagtagctcatcttgcgtgctctgcaaattagtcagcgtagaaccgcaccggaggtttcccaaaacagtgctggaagtgcaatgagacggctggaagagaatggaaaagcttgacttttcatagatggtttattttcttggttgtaattcttctcctcggccgagataggggactgtctgtgtccgttgttctggcgttgcatccatatgtaacatgcacacattatgcatgtaacctgcgccccttgcgcccttcgcgcccttcgaacgactttgatttgagagcgcagtgttcattgacatggaaccgaaatacgaaatggctcagggtgccatcgggtgatctatgctcgcgttctttcacctaccgtaagaattcattcgaggaagttgcatctttgacttaactcaacaaaaccatcctaatatctttgttcctggggactaagaagtacatcaatcaatggacttgcaacggcactgaatccaagctctgagctatgtgcatcgctagaacatcttgtagttatcacagagaaatcccgatactgttccaggtagcgcatcaagaataaaaaccagtaaaattccatcaagtgtgagataacgttacaaccataacgaggagtaaagttctttgtgaagattctacatcacgcagaatcttcgaatggtgacacgacatgaatattcggtgtgattgacgccaagctcagcaattcagaaccatcattcatataatgatcagtcctaccacccaaaaccttttccatcttcccattcctgttccctgcttgttgctttcatgtaaaggggtggaggcgtcttgaggtagtcaggcttataagaagacattaatatttcttttccatcctccaagacagaagcaggaacaaagttgattgattcttcatccttataattccaattttttgcttccagttccttgatatccaggacacgaccgtgaagttaccactcaaaaaagaggtcgtaggcgccccagcccgcgcctacaagctttggccggtcgtatgtgtggatatgccctcgagaggtagccgacgagaggttttttccagactcggaagggagcatgaatgccggtgttttggagatcggagcctcagcacttgagttagttcccagtagttgccctgggtgccaatcgaggccatcgcatacggtggagatctggatcccttttgggaaaagaactgccgtttccttgaggctttcggacactgggtgcgactctttcagctcaggaatcaatcgagtctccttgtcagtaaaattctccgttggtctccgaggaggctgccacaggttctaacccgcagcgttgtacgttttgagagaatcgaggtcaatcctcgcaaaagatttcaccttatccttttctttcttctccacgtaaaccactttcttcttctcatcaatgtccttgttagaaggcgaaggtacttgcacgggaatgagccaatacaagtgctgaatcagtggcgcctgaagaactctcttatccttatagtcccgttgcatcctgtccatgtgggcaaaatagttttctctccatgctctgtcctttttattttcgggtttccatgattccggatactttccggtgttcacggagtccaacttcttgccggttgccgaaataaccatcattcgacgttgtcttgaaaacatcgtcactgggaagattccaatcactctagagagctagttagatcaaagaaaaagatacagcgcgctcaggagctgactcacctaacaggaggggatttgacaagacggtgaaacagggcactatagtattgttgattgcttgaacaagccctgtgtatctggagttggaggatccgactgggaagatgagtaaaaattaactaatcggccagaagtcatgattttgcgaagcaaggaggaagaaatcactgactttcgatcgacaaggcgggcaacagaggaactagccgtgcaggggagatgagcaggagcaaacctggcataacagaagacgagtaaatgttgtgatgaaattcttgggtaggatcaaagcggtgcaagatggattattgtgccttgtgtgcctgggatatgcggcactgaaagagttcttgtacccaacgcgccgcccgctctctctctccatcacgtgcaccacctttcccctgtgttcaggcacagctcaatctttcttcacccaccatatatcagttttaacctcatatcgcagcctcaatttcaggggcgctgtcatactctattcccgcgcccatttccggtacaaacaccctcaacagcctgccggaaaacatggatgatcttcagcaaaaccaaacaacggcacagcaagcagagaatctagaggagtgggaggtcaatgctctgcgtgaccacgaactgcactcttccagatatttccagctgctcgagtcacgccgaaggcttcctgtctctttgagacgccaggagttcttagaaatatatcatgattcgcaggtcagtatccctcaaagccctccaagcgccttagagtagttccaaaactaaacctggacagattatcttggtttctggcgagaccgggtctggaaaaacgacacaaatcccacagttcatcctcttcgacgaatgggcgagtggtaaaaaagtagcatgcacacagccttgcagactggctacaacagctgtggctactcgcacagccgctgagctcgatgtacccctcggggaggaagtaggatatagcgtccgcttcgagaagaaattgagcagaatgacacgattaaagtatatgactggtgggctccttctgagtgaggcctcgagggaccgcgatttttcagcatacgtatgtgtcccacgggccacttggctctctcatcaccatggtccagcacatccacgagaatatggacgatggggatatcctgcggttcttacctacctcaggtgatattgagatggtttgctccatacttcggaagagatatgatgaagatcttgccgttctgcctctgtactctgcactctcacgagcaaaacaacaggaaatattcgaagactcggaatatcgaaaatgcattgttgccacaaatgtcgcatagaccagcatcacaatcgacggaatcgtttatgttgtcggtgagtatcttcatgatgtgtttccttggaaggtaggaattaacaaatctgcaacagattcgggtctggaaatccgtcctgtttacaacccgcgcctcaggatgtcgagtgtacttacctgccccatctccaaggcgtctgccaagcagagagcaggtcgtgctgggcgaacccaacccggaatctgcttccgcttgtacacagggcaaactcacgatacgtgtttcattccttctgcccctcccggtatcttggaaggcgagctcgcatcccaagtccttctcttaaaggcgatgggtttcgaatcagtcggaactttcgactttctcgatccgccgtatccctaggtctatctctgcggtttgcaagatctttgcgcaatgtaggagcccaactgtgtcagagcctatcttcttctggcaatcactctgacatagaacaggggatacattgatgacagaggcaccatcactcccaaaggccgcatcgcagcacgactatccgtccaccccaagtagctcaatgccttcatagaaggacagaagaacggctgcctccgggaaatgattgacctagcggccatctcaagcacgcaacatcctatattctctcgaccccctccagcgcgattcgccgccgacatcgcccaccagaggttcgcatgcccgctgtcggatcacatcagccagcgaaatgctttacgcgcctacgaatccgctatgaagactaataaccgactaccgattagccagtggtgcttcgacgcttttctcaaccgtcgagctctgagcgaggtcgtcagaatcagagaccaattgctcgcttcgctgcagcaggagttgtcgtatacgaaagaagtttgcgggttcgaggatgcggaatatgatactcatatccggaagaccctcgcccggagttttttctaccgagtgcgaatggctaattctagagctcgcttctgtttgacggatgcttcaactgattatcgcgtgttgcttatcgaaccaggcatgcatctcttgaagaagaaacgcctacacttccggcaagggctggcttggtaccatctgggctatgggtactctccttatgagtctgatggaaagacaatgattaataaagatggctgtgattcttgccacgccgaaaagtccatctgatgcctagccactgtcagcacaaggcgacataacaacggggagaaggaggaggaaccataactgtctagtatagccctatcaatgcctaaatttgcccaaggatctcgagcgacggttccaaagcatctctcatacctcatgtcatcccaaacgagatcaaacaattacacttcccgtaaagtccgggcttactaatatgtagattgatggttttctagaacgatgagtgagctttaccaagggacagacctgagctgctcctgtgtggctactctcttagtaggtgggtagttagtacggtaacttactgtgaaccggtgggtgactcttacgatgcggcatcaccaaaataccccggtaagctagcaaaagttatggggatcaacatgcttccgtttgagtctgcgtaattttgctgtctatgcttggacatccgtaacagaagtcattatatcaatctgtaactatcgggtcttgccaccctcaacgaaagccatcagcgtccatcacatgaggggagtctctaaacatagaaatcaacaagttaattatatacccagcatcacacaacaaagttaatacatcaaagttcagcctttttgcccagccacgaggcttacgcgcagccattcatacataaggttcaaataggtaccaacaataacttacgctcagcattatgactctttcattgggcgtaaatgccttcataaacctaaaatcctgatcctgtttttcctcctatttgaaggccgccatccccgacatggacctttcaataagcaagccgcacagctcaagtccaagctgtatcccacatcccgttcgcacatcgctacacacaaaccaagtcccaagcatctgaccgaccctgcctctcgctcgatcaaccggatcaacaacagaacacgccaacatctcactcaagagagcaagaacctacgagatacccaaaagcacaccgaaggtgccagttccagctatcaggggcagcaagtcagtcatcttgccaaatcctacagctaccaaagataagcacaagcgatagaaatcgcgcaagtttctattaagaccgtagggctactcaatctaaaagagaataaagagcttccagatctgactaaaacacagatagccgccctcccaccatcaaaaagcaagggcagttaacatgacacaaatggagctctcagagcttcagaagctcgtgcaagaggttatggaagtgctccgccgaatcgaggcaaactccgataagtttgagaagagactcgattcgctcgaggccggcttcggtacgagattaaattcggccgagtcgaacattgatacaagcttcgattctagtgcagaacgggttggctctcccgaagagagcgttggactctttcacaagactaaggagaacgatcttcgtgacgcggtcgcatttttcctacctatcttctttttttgtttggctgttatttttgttatctttatttttgtccgttttttgtgttatttgttcctttgaatagaataagattctagggcgagcatcaatattccaaaaataattccaaacaaaaaagctaccttgcacatggccgtccatcgaacaagtccatccatcgagatgttttacaatgtacccccgccatgcggtatgaggataaatagcaaggagccagtacttcaagacgtaggaggttggacgagcatggccaggcgaataagcttatccctcgaaggggcaggtcggccgcccgtcacggcccctgcatgaggctccggcacttccgtgacagatccctgccgagcatcagcagatggataaaatgtatgtctcgaaggaggaggaggttgtacccggaatctgcaacgagtaacaatcaaaagaaataccgaatcccattggctaatatacgagaagaggaactgccggccgaggcacttgcgaaaggcgccggcagttccatgacagaacaggactcattttgcgccttcaacaccaccatccgttttgaaacttacctaaagaggaactgcttctcggtgaatgctcccggccattaaattcaatgctatgggttgagtgacagaagagtgtgagcgaaccaattggtcatgaggatactacgctccgtttacctagtctttcagcatcgaatccatcatcatcatcatcatcatccagcgcaaactagcgaattccggtataggtctgggttataacctttttttcgtcactctactacttcggggaaacatctatcatagatcaccaaccaaaccagaaaagattcgtatttaaatcgcaactcatataaagtctccaatccaaacccaatggttctacttttcaacccagttcaaggtcgttacccagcgtaagtagccaaggcgatgcgtagacgaggcaggtttactcgaatcgtccggacttgaggggctgacttccagaggcgcacgaggcagagttgaccttggcgtgagcagctccaatacagccaccgtcggtgataccaacaactatcacgggagttagtaccaaaattatcacaagagagggatacaccatcattcacgtcaagtttaaagggtatacatacgcttcgggtcatcgtccttccaggcgctgcggacatacttgatagaggtgtggccctcagaggtgaagccgaagcagtcagccaaagagtggacttcgtaggtggcctggacatctccagcgcagccagtctgggagtatccgtagatccagccaagtggccggctgccactctggggaacagccgagaccgaggtggccagggcgaaagcagcaacgatggctttggagaagaacattttgatgctgttgactgatgtgttggggttggtctatatgctggaggtcggcctgagatgttttgactaacaattcagctcgtaagttgagcggcgtctgaatctttatataagccgccttattgccagtcttccctaacatcaactcttcccaatgccatgcccctgcgcgggataccatgtgcccctgtttgatgtatcatccgcgcgtaagcaactttacgaggtaccggcagattatttgggctgccagcattccgtctaccttccacaatcagtgcagatccgcctcatatcggatcttttctctccacagtaggccggcgactttgatattttccgtacatccggtatatcaccagtgctctccgtgggctgcatgtgccgcgcacggtgacagtttcggcaatggtaaacgagttgttggatgcggcagctgccattttctcaaacggccctccctgatcttactgatcttactgccttattcagttctcctccctttctcgtcattcattttcatttctccctcggcttgctaagcgtcaccctggacggaaacaagtctgtcatggcggagtttagaagggccgaggagagattccatagtgatactctctctgtgctgggtcaagccacttatacaaatcagagcatctcacgcagaatagatgggacaggtaacattagagaaaacttgagtaattactctagctctagataaaatctatcaggtcaaatccggatcgcctgctgttctagatacgtcgaaggtatcaatcagatgtaggcgtctaattcgttaacacaattcaaaattcacacaattagttcatgagacatagccaagtgctcccgagcatcggtttaggtgaggctcggcagcattagtactcattacggaatggcttataaccatttccaccattactgttccgttacctttggaacccccttcaagcatctggctgggtcctttcccccctagcccaagaagcttaaacgttaacttcccctcagtgagccatgacgcttctgccaccgtcggctgtcactcgcatgcggatacgcagcttcagaacaccatctccaagtttcttgggacttggaaagtattcagactcgtcactgtcatacgcatcatccgccgtagagcaagcatcatctccaacactgctcttggggctggacacgatgtcagattctgcataaagcttggctccggaatcgacagcaggttcgagcacttcctggctgcttccatcagcaaccgcatcgtccactttctcatcatcgcagggattgtagtcaacatcgattacggcgcttggtgcaaagacgagagcctcgccagtccgaagtgagacgatttgggagaacaaagcagacatgtaatcgtcgcccttcagaaccagggggcgaactcccgcgtcgctggagctggttgcttccgagaagtcgtccgtgtcggccttggtgtgcttcgatgcgcctgcgagatgcttcttgagggcgaggagccaatctggggacgtgaaccgatggacgatggtcatcgtgcagagatccaggagcttggtcgaaatggtcggctcctgggtggaaatgatgacccgggcagccaggtgccgctgcatgcgaatggtgtgcaagagtccatccgtgagggatgcacattcagagctgtcattcatgaacttgtgtgcttcgtccagagcgacaatccgaccgacgtctgaagattgctcaagaaataaactgagacagattccaaagagggagcaagcgatttcggccgtgatgcatgggcaggagaggtcgacaatcgtcagctggccggactatttcgcaaaaaaactcttcgttagcaaagctgtcgacgaccaatactcaaagggaacatagattttcgcataccttgggaaaccagatgttgccttttgcaatgtcttgccgatccatggatgacttttttgccttgggtgattgcttctggggctgttgattcttcataccaagtttgtactgtggcgcctggtcctgaaccatgaaactttccagcgtctccagtctttgttgaagtggaagcagttggctgtcaagcatggcttcagcaccgatggtggccttgaacttgccatagttgaatgccagtccgcttcgctgctgctcaatgcgcaagtctcggagaattcggttcagcacatacaagtacagaggcattcctccgtcctttcccgtgtgaacggccatgaggccgagcatgcggctcgtgttcaggtcggactggttgatacgaagctcctccacgctcacgttcgggaggctgctgtagatccgctgtgcaggttgaagtgtcagtttcatcatgccagctctcgtgggtacggggaaggaagttcatacgcggatattcataatgttcgacggtgcacacagaacccggacgctgatatcagggttggacgacaggtacgcggcctcgcatggcgcgccggccgtctcagacacgaagctatccctgtggaagagcaagccggtcaagggtcgtggcagcacattggcaacagatttggcgagcgaattctccagcaggacggacagagtgtggctctttccggagccttggctgccacagatgaaagtactcgagggcgccgcagtattgtagaacacacggggatccagatctccgcttgcaaggcggtcgaggttcccagcggtaacatcgccgccaagtagcccgtactgagagaaggttggctcgtcgtcagggtcagatgattcataatcaacggctagacggacattctctgtgaacaagggcgctgtggcgaagtcggccatgaagctatcatcaacattatcctgcaaaagcgccagatgagcctccgggattcccgttcctgcggaggaggaggaagtgggagtaacagacgccatagcaaggcggatggatctgacagtgtatgcaaaaaaaaaaaaaaaaaaaaaaagagtctgaatgaaaatacaacaggctgtgtatcttgatgcaaaagaacaagcaacaggagtgtgcagaggagaggagatgatggagttgagatggaagaagatcggtgaaaacgagaaagtggggagctcgttttgctattaaatcaactgattgtgcctcaacaacaaaaaggaaatttgcggtcgataatattccgtcaaacaaacggcagaagctgcaggaggccagccaacgccactaaacaatcacacgctgatcagcctgcagccgtcacttcaaactaccgcgtcaggagccgaagggatcgcagttggtgccagctggacacgcaaccgcagctgtggagtgtctgggagtgcaattaagcctcgctttagtggtcggctgcaggtgaccgtccattattaattccattcacttctctgctctgcttcccgacggcaatttttgcttttgcagatacgcttgcccacatatacgaagtgcaagcggtctttgtcccgttcaaggcccattttttagcgaccagagaatatcgaatttggtatcttctaaaacacctattggctacttccagatcactaccgcatagtgtaccaggctaccagctggggaggagacattccccatatcagccacgactgtgtcgggcctctggcagatccgcgccagcggataattgctgatgaaatcgtgcattgcttcctatggtatgacacaacagtagatggccaaatgtcacagtacctaactaaatgcttgcctgattgccaaacaccaacgcaccgaccaaaagctcgtcatgtatgaggacatagacggaaggtagagctgatagcgactgggaaatttttgaaatcattgatagattataccatcttcagtccatcaaacggaattatccatccgcagtccaggtgcacccataatgaggatggcattttaaaatccatatttgaggccacccaccatcacgtcatgattggcgtggggaaccactacatttaccatcatccactccctgctcttcccctcactccgattgtcacctcatcatcatcactgaaacatcacagcaaacaccatgaccaacgtcgacacctcaatacccccccagaccaccggcgcagcagcccgcctcgcagcccgccacagcgccgagcaccccctcaagctgtacggcggctggttctgcccctttgtccagcgcgcctggatcgccctcgtggagaagaagatcgagcaccagtacgtcgagatcaacccgtacaagaaggagcccgagttcctggccctgaacccgcgggggctcgtcccggcgctggggctgccggacccgcccaggaccgtgctgtacgagagcagcgttgtttgcgagtacctggacgagaggtacgcggacgaggcagcgcacgggaggccgctgctgcccgggagtgcgtatgagcgggcgcgggcgagactgtggattgaccatgtatctacgagggtcatacccgggttctacaagctgctgcagcataccgacgggaagagcgccctgagcattgaggagacgcgcaaggagtttctggggcacgtccggacattggtgaaggagatggcaagcagcggaccgttcttcctgggtgagacgttcagcttggtggacatttcgttggcgccatgggcgaagcgactgtggctgattgaccactacaagaatgggggcgtggggattccccaggagggccaagatggcgacgatgaagtctgggggaggtggagggcgtggttcaaagcggtgacggaaaggcccagcgtcaaggaaacgtggagtgacgatgagcgataccttgccgcgtacaagagatatgcggacaacacgaccaactcgctggtaggacaagctacgagagctgggtcagggctgccgtgaggcttgatagtgcacagtatcactagtcttagcattccgcaagcataaatttaattctcagggcgtcaaaggagcacgaaccacacactaacttggttgtcgcttcatgaggctcatgaggcagcaagactggtctctcggtacaaacttcccatcccagctacctaccctatgccacacgggctgtcggttgcagctaggcaaacatggtcagtcgagagactagattcaaaagagggtcgttaaaagtcgaagatatgcaaagggtcagtaatatcaataattggtatccattttcgtgatgtgcaacccccaagtaaaagctgccgatccaaagagcagattcaacttggtcatacaaagaagtgctacggaaaaaaaatagcacagctggccaccaacattagtttcggacaaagatgaacatcacaagcaacatcaaattagagaaatataccacttaatagaagattcgttgaagtatcttgtagttataagggtaatgaaagaatatcaaggccatggccggtcgcattgctatatttattgtcacccatgcatctgggataagcggcggcggttaccgcattggggttcccaacttgaaactgtccagcgacaatatcgataagagctcaacttatcgataactccaacgactcaccgaaagccccactgtaattctcccatccggccaaggttcaacaacacaacaagccttgcctcggcctcagtattcccgtcctcacagccaacgggcaaagaactcaacctctctctcctctcgtactccccgcccgcgcacgtacaaccnnnnnnnnnnnnnnnnnnnnnnncccccccccgcgacgccacacaatgtccgaccaaccctccaacccctcccgcttcacctcccagaccgtccagaacaagaccaccaacgagcgcctctccagcaacacagtcggcctcgtcaagctctccgacttccgcaagcgccgcgccgaggtcctcgagcagcaggagcgcgagtcgcgcgaggtctcctcctccgccctgcgctcggggaccgtctccacgcgcaacagcacgcccgacgtgtcggagggcggcggcgacgacgacgaccagcagcagcagcagccgggccgcgcgccgccgaggaagaaggtgaagaataagaagcagggcagcaagaagaagctcctgtcctttggggaagatgatgaagaggagggagaagacgaggacggcgggagcggagagaagaagacgaagagcaagttcaaggccaattcctctgtcggcgtggtgcccaaggccgtgaccaagtcggcgctgcgcaaggaggcggcggagcgggaggcgctgcggcaggagttcattgcgcagcgcgacgccgtcaaggctacggagattgcgatcccattcatcttctacgacggggccaacatccctggagggaccgtccgcgtgaagaagggcgactttgtctggttcttcctcgacaagagccgcaaggtcggtgccgagctcggcgtgggcgagaaggcgaatgcgacgaggacatgggcaagagtgggtgtggatgatctgatactagttcgtggaactgtcattcttcctcacgtaagtctaactactctaatcttctatcttgtccaccttcttttttctacccgatgtgtctatatgttcgactgacattttctagcactatgacttctactacttcctcgtcaacaaaagtcttggcccaggcggccaacggatattcaactatagcgccgaagcaccgaaaaatgtaccgcgggaagaagctgtcgatgctggtctcatgaccgcggccgagatcaaggcggcagctgccaagaggcttgccgatatcagcacacttgagggagcgaatgatgatcccacgttgaccaaagtcgtcgaccgccgatggtacgagcgcaataaacacatatacccagccagcacgtggcaggacttcgatccggagaaggactatacgtctgaggtccgacgtgatgctggtggcaacacgctcttcttctcacggtgattccgcttgcaacatgtggctctcaaactgaggagtacaaggtcaatccggccaatgcagcgtccagtcgccgtggcgaccgatatcctgtgtcctgtgatgtaattgatgtgataatcctggacatcatggaacgccttcaaccaccaaactgggccacagccaacactgcgcagccaatgacccaccagcctggccagaacagggcacaaaagatggtatttccgctgcccagaacccacttggcgaagtcttcaaacattcttttgcgcaggcgctgcaccgctgcagagtcccagacaccagcgaggagcttcctcgacatggctgcaccaaaagtagtcgcaaagtaggcctggacagccaagattcggcttgcatacaatgtcgtggctgcgaggaaccgggtttggaagtagagcgtaaccgtcaaagcgctgattgctttctggaatcgctcgtcgaggatgaatgctggagttgcctggctcaagatgttggagacgggagccatcgcggcgacctggcggtccacgcgcgagactgtgaggagagtgaccttgtccatgactgcctttctttcacgattcaaaggtagtgttttgccaaacaggatcttctagttacctttcaaatagaaaaaggcctcaccccacgacctgctcacgaggggttaatataagggcaggcctcgtttatgtatatgctgctgtcacatccaatctgcccctccgtgatgcccaagtgctccaccatacatcccggtatacgaaaggttgttgataagcccctcatcgactgcccaaccacggctctttgacacggcagatggtggtccataaagacgcgaggggcatctgctgctgccattttggaattcgcgtctctagatcatgcaattgcaaatgccatgataatccaagaccctctgcacgtgggcccgctgattcgtggaggcggagagagccaaaactcaaagggcatgcctcatgttcatcagggacctgccctcgtcgaatgaggattcgagaccaccccagtttgaagcattctctggagccgtggtggtgctctggcttagttcacaggccaatgagaagccccacgtggacccggccccggagccgatcgcggtcatgttcattcgggggtggctgattgatgggttgaatgagagaagagcaaacgagatccttctacttttgggaatggagggctccgagggccgaccgcggggttatatgagcggctagagcggtcctttggccgggtttcccgttgcagcgtttcaattccttgacctcgtgatgcttcggcccaacgcactttgcttatgttgataatgtgcccgcatattcgtcattctaattgataatacccttgactgggagccagtcagacatgttaggaggcgcattgatacctggtatgttgatttgagggcacaccattgcggaatcgactgtgccgggcaggtgacatactgtgaagaccatcggaactcgacacactttaggatgggttgttcccgttggatgcttcgggtagcttcaattgtcaagctttaggcgcaatgagatcttggacagacgatcttcagtgggatagcccttcaaataacttgttccgaccccgaaggtggaggcatggcatcgacgactacctgctgaggatgaataatgtcagtagtgaagaatgcaagaccagccgccaagactttatcacctagacagggcgctttgtcaagtaaatatggagtaccacacgaaggaaaaccgcctctatgtgcggcgcattgctcactggtatgtggccacaaattccctctgatcatgctgggagctgggaatgatgacttgaggtggatccattgtgtccatcgtgttgtgacctaatattggagatgcgacctgctgtgtcgcccaatatccacgacacaatgacttgaggtatagataagtgattaataaatgagaccatggtgattgaagattgatattctcagggctagtgtcataggaaacgagctgcccatctcacacgggcacgcttacacctcgtacatgggtgattggcatgttggaggatgatttgagcaacttgatcgtggaggctagtcaatccaatgagtattgtggatttgcgagactgttttcttgcgctgtgggtttttctctcagccagtccccagggctggacttgggggcctccacatcttaaagttgtaagatgctgttgccaaaacaatcacagaataagcggtgagaacaattttttccccccaggtgaagtgttagccgtcttgtcacttgtcgaacacgttttgccattcacatgatgcggtatgtacctgtgttgacaggacttctcatgtcgcgtacgccggtaggattactcatgttgaatggatgtgctgcagcagccttggcagcctctaatgctggaaccaagtcccgctaaagctgaaggggaaatgcatatctggaggatcgccagtatgaaactgtgactccaaggtgctgttgttgatcagtaccttattagttcccgagatggaaacgggagaagctgccttggaacgatcgcacgtgcgaggatgaaaatagactccagtctgttggttcgtgaggagagcaagctcccaagccactgggatgtcgctaaaccagagtgggcagtgtcatccataatatccggcactctccactggatggaagagcacccctcactccccacaatggcatgctccgttcggagagttccaggactccgggacatcaagagtgtcgaggacaacaacggaagtccgccgttggaaggcgaaagtccgcaaacgctgggtgggctgccaaggagtgatccaagcgcgccgaggcacacgaagctggtggcgtaatgtcctttgcttcgtccggctgacgagggctgaaggcttgtgtgggttcgttatctcgacccctttatattactctgcgcatccctgtttcgagctcccacaggatccgacgacgccagacaaggagtgatcggaaactgagatggggacggagattgtcgaaactcaatgctgctccttcctcagccgctgtttgaagtgatgcacgtgatgagctggctgtgcgacagccgcagggaaagagcgagtgggtggattgggggtgagaacggacatggcgccatccagacgcttaacctgaacctgaacctcagcccgaacagaacaggaattttggcccaaaacgtcccaaccgccaccggacaagttcctccttttcggtctgggcgctgctcagaagggaagatcactggcctgaaagaatctagctttatcgatcgctgactacctagtggcctgcctggcttctttacagcttcccttcggactcggccagatcaagcccgccgcggcgtatgcgggcgatcaggtcgcacgggtaaggggtctttgatctggtccgaggccctgggcgatccaaggccctcttggtgctgtggcggccgacgttgaggtgagacggtgctgtcaagtcaaagacaaaagttcaatccgagtgtgtgtccgcgcactgactcagattcgagacgcagggcacaccacacggcaacccccggtgcaaattagcacccattatcgcatgtaagcctcgtctggtgcaaggaatggtgtccccaggctgccacgttattggcccgtcgctgcgctctcgagacctggcggatgggattttttgacgagcgaccagggccttcttctcgatcgggccgcacctcaggccaatttgttaatagtccaggtgaaggtggatgtggacggatgggatgaggaactagcccggcaaaggctaaataccacgaccttctcgccctcattttatttcttcggccccttcggggtctcgagctaggccagaaacctgagaggcgatcattcaagcttgtcctcgtcgctaatttcgtcacccagggcgctcctcacccattcaccaaaacatccatcgagtcctgcgactttttcccatctgcatccgcgtgcagccatcgcaccgctccatcgccgccgtttgtcgatcatttccccggctccagatggctctgcacgagtagcctccagcctgcgtcgacaccctggctctttggatccgactatgatctcatccgaccgccgccacgatgtttctggctcaggttgcagacgcactgcatgtccatcattttggccttctccttcttgtatccgccttcgccgccattctccaccggcatctccagcctagaccgtttcctatccatattcctctcatccgcgagaagcccgacgcccagcatttcagcatctggacccgtatcgcctttcatttgaactgttcgtcgctttacagtgaaatttggcacaaagtatgtcggtcaactttatcatcccgcgcgcatcggccccgttgaatccccactaatttcatcgtctccagttctcaaagaagggaaaagcagttgcagtcccaacgcttggcttgcgcaatgaggtcttcctgcctcacagctcgttgccatgggcgctgtcccagcctctccgtgtcctaggcatgtgggaggccttcaacgagcactttcaactggtgcacagtctcggtgatgagaaatacatgactgacacctggcctcatcttctgtcaaggcataccctcacgcacgagatggatgaccatctgatggacatccatgaagaggtcaaggctgctatagatacatatctgggccatgacaccgagaactgggagacgctgaacctgctccaaaccgtgagaatgattatcgcacagacgggcacccgctttaccttgggaatgcctttttgtatgtcaagaccctcattatgatgactctatgagaatgctaaccctcgcaaggccgtgatcaatcatatctccacactatcaaggatactgttgacagtatcgtcatcaatgcgggtgctacgggcttcttcccggcacccatccgttcctttcttggccccattgtctgctggcctacacaccgtaaaatcgatcaccttgcaaagaaattttatgacatggagttcaagagccgtctccaggacatttcaagcgacaaccccgaccaaaagttggatctcgtccagaagatgcttcgacacgcacggaaacaccgccccgaagagctggccgtcgagcagatgacccgccgcgtgtgcatgtccaacctcgcctttatttaccttgcaagtttcactactaccaacctattttccaatttgttagcttccgaccctcaatacgatacagtagccgttctcagagaagaagcggcccagtttctcgctacagaacccgaccctaggaaactatggcgccgggagaacaccaacaaattagtccatgccgacagcctgatgaaggaaacgttgcgtctcaactcggttccgacgagagctctggcccgacaagtgatggttgatggagtggtcacagatgcgggcgttcctctccccaaaggcacaatcatttctttcgtcgcccaaccgatgcacaccgacccggacaaatacgtcaacccactgcatctggacccctttcgcttcaaccgcttgcgcgaggaggagacgtcaaaggagaaggatggaccagctcgtgaggtaggaggagaaggagatcccaacagcttcctctcgacggcaaagctcctggcttttggccgtgggaaaaactcctgccccgggcgctacctgatggactaccaaatgaagatgctcctcgcgtatctcgtcctcaactacgacgtcaaactggcggatgagcatcaaaaccagcgaccacccagccgatggatcctcgagttcatgttcccgtcgggggagaccaagttccaattcaggagacggaaaaatgccccaagctggggggccaagtcggatacatagcccttcagcggcaagcaaacccaccttccttaccttatgactgatgacacatggcgacttttttttttcattttgtttctgtacagtacagcatcggcactaagacgagcatagcacaagcaacctgcgtaattagataaaaataatgataatgattaatttatcttgattctacctactttcgcttccaacgtccgaggagtgtgcaccgtaagcacagatctcactctgataatattgtggcttagattctctgagtgctgatgatgatgaatgagtaacgatgcatcttggtgagaatatatgcaatcaacatcatcatgccctcctcacctgcatgcatgataagcccacaaactggtctcagtgaccatggtgaccccacatgactcatggtgattattggacctcaattggctttattagcaccctgagccgcgatcaatcaatttgacattggaaccaaaaaaaagcaacaaataccatcaattagaaatcaaactcgatatcaatctagcatcatggactacccgataatccccggcaccgagctgatccctcagccgggcccccagtacgatgtcaccgccgacgctttgacttcaatccctgcgctcacgtccccgccgtccccgaagaagggcggcaagcacatctttgccttctggcactcgggcatcgccacgctgcccccgtacctcaagaggaacgttttgtcttggtatcagcggttcgcgccgctaggatggaacatctacgtcctcgatggcgtcgcggactcccccctccacttctcccggtacattgacgccacctcgccgtccgtggtcccgcaggccctcatcgacggtactctgggtggggggtacgcctcccagcacacgtccgacctcgtgcgctaccctctgctgatcaactatggcggcgtctacttggacgtgggcatcctccagttcggcgacctgaactggctgtgggaggagcacctcgccaacccggactcgccgtacgagttcgcggggtacacgatgggggagccgcccgagcacatctccatcgtcaacttcgccctcatggccgtcgccgactgcccgctcgtcctccgcgcgcacaggatcctcatcaagctgtgggagggcaagactagcaccgtgggggcgcacagccacccgctcgtgtcgcatgtgccgctcatgcgggttccgccatccgtttcggagggaaagggaaacatggatattaatgacgagagcatgacggattacgccatccagatccaggcgatgggctccgcgcagcgctggcttgacgaggcgggtgggtggaatgggcccgagtacgtccgcgacaagtgctggctttacaacatgcttgagatggcctatgtgaacgagaacctgacggactgggacagcaagcggcaatttgagctgtttgcgctggagatgccgaggagcggggaggaggagacggcggaccagaagctcgcgagggagattgtggagaagagcatcgcgcagagctggtgtttaaagctggcgcacgggttctccgcgaagctgttcggtgcgcccacgttgggcatgcattggagggcgaacgatgggagtgactgcggtccggggacgtatggcggttggttgaggtgggcgatgtcgaacctcacgcagaagaatcctccggcccctttgagaattccagtatacgagccgactatggtgggcagcctgaatgatagactctaatacctaattatccatagaccaaatagaaaatagagaactctttgtcgtgtctacagtagtgtgatggacagattgacgagtgtgccgagtttgtcagtaccggcttcccaatatttgaggcgttgtcggttgacaggattgtctggcgccagcttggcccgggctagctcaccatatgtcgcaatatgattacctttggcatggaaggtcctctcaatctcccattcctcgcgtgttcgcgcttcccacaaggacttgggcgagatgaggggcaggtgatcaaagtgttcgtgaatgccgcatgccacttgtagtcgcgaggccatgacctggcgcatgatgaaccaaaaggcaatgattctatggtcgcaggtcagccattgtgtgaagcattgggttgttcaaaaaactagattctttcttaccggcgtcgtgtctcggcaacgatccagtcctcccaggtcgggcttggatttgtcttctccgtggagaaaaactctagttgactagtgaggtcaagacatcgcaccgtgagattctgtagaggagattagttcgagcttgaggcttctactgattgagaaaacttcgcacccagtatgtctgaaccagacgcaatccacgactgaccatcgctggctcatagtcgatcttgagcatcacggaatagatgagaacgcactgtatagcatgctggactgaatatatgtccatcctgctcagctatttggaaattagtcaatagtcaagtgtaggtggtggcaggctgagcaatattacctcagactcgatgcgcgtaacttcggcatcaacagtacgccagaggaaggaggcagtctcgttggtccgagtctcaaaaacctgtgcaatgccccggcatgtcgatattcgttcaggcataaaagcactgtatgatgggatgtgcatgaacggtggaagcgtctggttacggagcatcatttgcggaaaacaggacatgatgtcgaacgcgagttcgacggtatggcacacttgatgcaagttgtaccgcagaggcccaagctggttatgagggccagacagagcgtgctggacggttggactcatgttgtgtgacatggcaaggttgaaccactcgcccacgtcgggtttttgaaggtcgagctgcaggtctgccagttccagatcgacgtcggccaaatctagaacaccgttgtcggcatcaaagatagttatatctggactttccgaggcgaatcccgaggccacgaccaagctattagctcggtctggcgaagacgtctggctctgacgaaccacttgaggatcctcctcctcagctggcagagcggtggtgagctgctgctgggcgcgaccaggggcaattttgcgcgccgcctcgttgtaaacgcactcaatactcctggactcgcatcgcgcgcacctgggcttcgtgaaggagcattttatctttgaggaactgcaagcagcgcatgagaccggccggcctttgcgcttggcctgggcacgccgacaatatgacacatggcgcttgtaggcggtttctgggtgaacggtcagccatgagtatttatcgtgccgcaatacaagagaattgttggcctacctagaccgaactccttgtcgcagatggggcattgtctcggcgaagacgttggcggccccataaagccggtatcatttggtctcatgaggtcgtagatggtgatggatgagatgagttgatggagtccagtgaggccagtgggatgaaggcgctgtaaagtatccagtttcagcgaacgtgcgttggctgacaaactcagcagagtagcggtacaacacgaaccagttgattctgggtgtttcttatgtacatatacatctaaccaaggcaggcaggctgtccccctgtattatctccttaaagtccgctacagtcactgggagcacgttttcaaaggtgagaattaataaatcaatcaatcaacgtttcagttaatatttgtatctctattctgaagagtatatgaaaatagtctacataaaatcccaatttttatccaaacaacaccctaccagggaagagcttggtccgcgcgggtaaaggtccccgttggaccatcctcgcccagcgtggccatcttcacaagctggatagctccctcctccgtggtcgtgccaaacttgtgctgcgtcagattgctcgacacaagcccggggcagacgacattgaccttggtccctgtgccttgcagcttacggtcaaagttggacatgagcatgttcactgcagccttgctcacatcgtaggccgtgtaatcaatagggtaccaaggggtggtcttatcgagcgacatggtgatgctcgccatggtggttgagacaaacaccaggcgggcaggctttgccttggcctccttaagcaaggggagcaaagcttcagtgagcacggcggggccggtaacgttggtttccagggtcttgctgtaaagatcccacgtatccttgaactgctcgggcttggtgtcgatcaagatgcccgcattgttgatcaggacgtccaggtagccaaagtcccttttgattgtcgagacggcgctctcaatggactcgggcttgttcagatcgagttggacggcagaggccttgtggccagcagcgcggatatctgctgcggccttctcaccagcctcgaggtttcgggaaccgataatgacatggtagccgtgatcgcgggccagacttttggctgtggccagcccgatgccctggttggcgccggtgatgaaggcgatttggcttggagcagagctcatggtggatgaataagggataaaagataaaagtgtgatcttagggatagcaaagtatctcctctatgtttaaatcaaataagtcgagttgtttctcgtgtattggtttggtctgaatgcttttttcttgtgcttggttgtgttctaaatatcctgccctttggatctgggctcgctgtcttatatacttgaatgatttgcctattatacattcgcatattgataatcatcatttcactgaccaagttgtccgatgtatagcttagtttctattcaaccctagtgttatttgagtcttcatatgttacaaagcccaccgagtcgcaagagattgtgagtggatcatcatcggccaagttggccggcatcgatccaataccactcggtcaaattggtcgtcccagtggaatatttgtaagcgcaaggctcagctagaatggagccacacccattgaccgtggcccggttgccctggtttggatctattgttttcggctgataatgatgccgtttttgttgcctgccgggttgtaggtggtaacaaagactagccgaatagataatgaacaattcgcctgaatcggttttccaaggacttgcttctttactgattcttgtggttgctatagtcaatcaaacaacagtcgaagatccattactcaaatgacagcggcgtattggggcattgacttatcacttctaccgccggctaagaatgcatgggcagcatccgaaagtattcagtcgggcgatactaggggacggcaattttgagaaggagagaaatcataatacctcgacgagttgcagaagatacattgaaatcaatctatccgcccggtaaatatttcctgcctttttagtagggtgacttatttcctatcttgtggttgggcatgatactcgttggtgtcagcatcaagtttcgcatcatgcacttgcttctacccgcgattcctgccccatgctgtccgtgatttagagttgcctgctgctaatatggtgagtgcatgcacaattcacgagccaaggtgttcgctgatggccacggctgcggtggatgatgctcagccgaaccaaagtcccaggacaaggcgaagtgtttatgtacttaccgggtcgcgaacttgcgtgacggtaagctggccgcctcgataatgcgcaacctgcgggggctgtctcagaaatcgcgaatacgacgaatcagatatcaggcatacctacataataatagccgtcgctgtctttgtatcaggctgagagccggcttcccctctccatcctcatcctctccgggcttctttgcattcattcagcctgcatcatcatcattctaccatcaggactcccgtaataataccgaagatattgacagtatggctgatccccctccgccgccacaccccgggatgaggccaggagcccgcgacttcttcatcaccaatttcgtcgagaatcccccgcctctagcacctgataattcagcccgtgcccagtcaccacatgagtcaacttcgtccgaatctgacaatgatgaaggttctgggttaaggcacgccaagttagagaataattgtatcctctgtggcgataccctgcacgttgactggcgctcatatatcgacccccctgaccgtctctcgaagtgggagacaaatgttatctgcagtacgttatgatatccatctacaatctacctatgctgtcatctcttccaaatgtcctaatcggtatggatagtccttagtataccatctagcaatggtcgaacacaatcgaagttgtgcaacgcccagataaaccaacgccgcgtgctcagaagccgcaacttggagtatccgccggggacgaggtatcatccttgtccttattacggtggttgcccgaggtgcgatggagaggccgcgctcaacggggtccaggccacagtcaatctggtccacctccactgctcgcaacttgccaaacgaagatggagcgacttttcggccgatgtcctagtccgcatcgctcggctgctacgtcccattacttcgtcggaggtgggtgcggagatcttgggtgtgaattctaacctgaccaaatttcccgaatccgaaatcgcgtgcaaagattcgagcctgggtttgctgcttacgaatatccatcgccgcctgcccggcgagcttcagagcctggtatgccagcatcttcagggcaccttcttcttctcggttgccagctgcgtagagacattgcattggatagaagaccaccggatcctggcagattcctggtcaattacgatcccgacatatcattacccgctcatgccctccttttccttcaagcgtcttgttgcagatacggtcaacattctcggcgagagctgcttcacaagaattggtggagacttgcctacctcctacgaaatggagatcacgcttagacaagttcccctatcagggatccaatatgctcttggtgtccatggcgttgttggtttgcgggtcctgtatgaggatggctcacggtcagcttggttgggccgctctcccggcagattattcaggattttcagtcttcgctcactgaggtatcttcgtattctaacagatgtaaggagtcatcaacgctcttcttcgtagcttccttgtcttttaagttaacccgaattctagggactgaaatatctgtcattagacagcgataccacgagtggcagccaggcgctagcaccagatacgagttcaaaggatgaaccgttttcgaaagagcccaaaatcttttggaaccgtgacgtcgacttcaccccctatgataaacaatttctggtcagcataaatccgatacaccgaatcattcgtggccagaaggatgcatatatcggacaatatctgcctttccaaccagttagccagcaacaccggagcctaaccattttcttctcctcggaaggcacatcatgtatccaggtcggcagtgacccggggcagaggctcggcaccccgtccatgaaatctgataggccgcttaccttctatctttatcctggagagacgataaagtcgctgcgactgctcgctgtagtacgacagtggcgcccaaacgagtggctcatgcgggacttgacccacggcttccatatccttgtaagcatttatttccaatcccaccctaaagctaagttggcccggatgcctaacggtaactaggtgcaaacttctgaggatcgaatgatttacgcggctcctaatcggttgcttacggatcccgagtgttccttagccgtcttcggcggggaaagctctcactttccacacgggatgttcctcgtgagagacggacctctaaaggagtccttcaccaacatcggtgttacatccggtacgagtaaggaagagcaacccgatccacaaaaccctcaagcgactcaaggcccttggagtatcacggtgccgagaccacgaagcgattcgtcgctcacgatggaaagaaaaggcgcggtattgactaaagccaacctcgacaatgtgaaagagataagagtgcaaaagcaccagggaacttattcgggtctcttgatccaccgtcacgatgacaggacggatgtcctcggcagctgggatgcgtccagacccgatttgatctcgactatttacgtttatggcgacagatcattcacgggacttacctttgtcttttcagagtatgatgaatctggctcgccatgtattaatgtggtaaacatcacgctggatcaagttgacaactcggtttcgaaattccattgggatgctccttacttggtaggtcccgggattcactctactcattgttgttaggtattatcttctttcgttatactgactatttcttaggaagtcgcttggtggtttacactgtcgaagtcagaaaattatgtggaatactgggatggagaggaacaggaagtcagcttgtcgaagggtaatcttcattgtgagcaagttaactaagaaagggactagtaataattaccacgatatcctctttttcttttctgctaatataattataatatcttacgcgatccaatgaatagagggcactaggatcattgcaattgtcagaacactctctatgggcggacccaaaacgaattccgtgattgaaatacagcagacacagtcaattaaagcgacttcggctcttgtatccttttgtagaaatgagtttcgggttatatctcgtatattttggtcaaacctttgtcgtgcatgaataacagccgagatgaatgctttgcggcccaactcatcgatgcgagagctcgtttgcaatattataaattttaaccttgctttgggctgaatttttggaaagtacacaactctttggaatttagggctgtgtttgaaagcctcatgcacgatgctgtgagtggcggtggctgttctggagggctgatcatcgggctgacaaccgctcatcattcttacatttctgccgaattaacgtaacattcatgcatttctgcctgaccaacatgtcatatacttctgccccgtccactcaataaatctcgcaggaaggtagccaaacaatctctggtcaagatctactggtgaaaacgagtctttgttctagccaaacactcattcaaaccgagaaccaacttttcaacatggcagcactgcaatattctgcactagatgcggataattccgagataaggctcctcgacattgcccctggggacggcgacgatgagatatgctgctcccttagtgtggtgtctctcaatagccatccgcaattcgaggctttatcgtacgtttggggggatccttcgatcaagaaagatgtcacagtagatggggcttctcaccctgtttccctgaacctcgagtcagcactccgcgatttacgatacacgtcaaggataagaacgatttgggtggatgcgatttgcattcatcaggtggatcttattgagaaaaaccaccagatccctttaatgagtgatatctatcgaaaggcatccggagttgtcgcttacttggggcattcaaacccatgcttggagctgtttataggctggtcacaagtgtggtctcgaaaatggccattgctcacctcctggcgctggatgaagatggaattgcgatcttggatcccacagaaaggtgtgagaaaaaggaatgtattgaagctgcaagcattcttgggtttcctcgaattcgtctgccatccatatttcaacaggatgtggacttttcaggaatatctcctgccaagtcgcaggccaacatttgttataggaacgaaaccatttcagatgggtcacactgccagcgacactttgagaaatttgctcctgagatattgcagcaccaaactcaaggcgatggagcgactatcgagagcaagtgaacgcgaagcccaagaattaatactcctttgctatacaagatttacacagtctatgatggacggtatgggcgagcaagtgtatgctgtgggagatcttttggcgggacaaagtagattgaacataatgactttatttctcacgaccagtccgcggagttgctctgatcctcgggacaagatctttgcgattcacccgtttctgcaagaaatgatcccgggaatttgtgctccagactacaccaagtctccggatgacgttatttttgaaacgctttcgaaaatacatgaacgcttcccccaatttatatggcgcttcatggaaatttggccactccgagcctccagtatggaagatgctttgggtccttcatggctttcagacatcactgcgacaggtttccaacataccaagaacgccgaacctggatcttccacgttgcgaatctctcaagactttctaatcttaactttaggaagtcgtttcattggaaaacgtcacccatctccgatagaactaggtaacgagcctgaggaaactatacgacgcattgccggactcatgtattccagtggagaagatctacactccttcgcaggctcggaaattagagttagaaggaaggaaaccctttctgaacggatattcttcgcattacagaaatggttccgagtatggcaacagcaaagtccagagaaagtccaagtgctattttccacttttagcactatcgcacgatacaaggacattgggaagcttgacgatattccgttcactgcagtgcagagatgggcttttcaccacgaattcaaatttgcggcgaaatattttaccaacaaatcctttttttggacggatacagggctattcggaacctgttcggacagactgcaagaaggtgacacaatagtgctttcaactgaattctgtcgtccctgtgcagttcgtactcaccctgatccctcaggtgaatctaaccactatcatatggttgattgggtttttgttgatgggctcgagggtgcgaccatggatgcccaacttatgagcgaggttgaagaaacacctttgagcgacatctacattcactaaacggacataatttttcatacacctgctcatcaacgtagctgggatttctttaaaataaattgcttcatcctcacaccgcaagattacggggaagttgatagaccagaccgacagcgccacttctgggttggcattgagtgttgcgacgccgcgatgggacttgcaaagaaaatttcacacccagtgatattctcactcactgactataaggataactagcaaaaaagagatagtggtcgttgttgttgctcctactggtgtagctcgaatacattatgttcgtaagtacccagcagagcatctcgagtctgtacgcttccctcaaaaactcaacatctggccatgtcgacagtgcatcctgatatcccatttaagcaagaaccgaatacgacagtaggcaaacagaagagaagataacacatggaatagcagtgattattttccatattttcgacctgtcattgccttcaaagtctttgcagaattcttaccttgatataattggttagttgacatgtcatgttgggaagtcaacgcagccagcggttactttagtacatcaagttatacacaaggctcaaccaattgcaccatgctctcgagaaggacattctagtgagcattgagccatgggctaagccttgtgtataacttacgaaccagggctgggtttctcgcggtacgcggtagcagcattcatcgacaagtggaaggcattccgcaaggctcgtccggaaggagagttgccagggaaaaggccaattggtgttactagagcagagtagaagaaaagaaacgaggccctagcgggaagaatctggttaaggcaaaagaaaaatttgaggaaaacaattccatcccgcaatcgcatatttccacatgaaatcattacacattcgcatcgtcgtcggtcgactcgccgcaaatccgagccttctcctgcgccaaaaacacctcttgctccctcgcgctcttctccaaatcgaggaatgtccagattcccgccgtacttaccacgctcagggcgaagaggaagtagaatggcgcgctgttgttggtgcccccgggcgacgcgtcgatgatggcgctgctgatgaaggggccgatgaaactcgaggccttgccgatgatgttgaagatggagaagaagaaaaattcgtggccgcggggtgtgacggagctgatcatgatctgcgagtaactgtaccatgggcagacgaggatcccgtagaacgcctggtatagccagaactcccactcgttgtggaatccaaatcggtcggtccagttcccgatcatgccccagccgtcgaggaggatgatgcctatcatgacaacgttgaacatggtcttggccgtgaggttgaatctcttctggatccaccagaacccgccgataccaatcgcctgcgtggcgatgccaacaatgagcaaataagtcaacgtcaacgtgttgaagctgaccacctcgttttgcagcgtggcaatcgcggtgacggttgtattgagagaatcacccaacagaaaatacccagcgaggaagatcatgctctgcttcaacctccacatttgggccatggcctcgtagatctgccagaagccaacggtgaacatgttgagcccggccggcaccatcatacccggcctcgtcttctccatgaagaaccacggcagcgagacgacaacccagacagccgtggcgaatgcgacgagaaccgagagcccccaattgttgttggcggtgctggcatcgacattgacgccgaacatgatgccgacgataatggcgagaatgacaatctcgctgacggactggatgtagaaggccacattgctcagcctgctccgctccatctcatcccggtggtccagttcctgctggctgatggtcccttcttcatactgtcgcgctgcctctttgagcgtttcggtgttgcgcgcaagggtagggaaggccgccgtccagtaggtcaaggtgagctggtagcagatgaggccgacaatatacagggcagcaccggccttccacttctccgggtcgtgaacaccgagccaagcgaatccaataccataggcgagaatagaccaaacaatcaacacccaccgacgcccagtaccaaaatcagcgtaagcaccgatgaagagaaacagaacagcctgcagagcaaaggagatgccgtttgccacgaggacaatactgttgacatttcgttcatggcccgcaaacatcagcagccccgtgtcttctggcgcggcctgagacaggagattctggaaggcggtcgggccaaagttgaagagggccaggccgttggcgccgatgtagtagctataccaggaccagatctcgtacttggtggtggtgggcgaatcagccgacgttagtgccgggagtatgacatgacggtgtccgtcgtctgccttgaccggctcctcaaggtcgatcggggcctcggccgccttgatcggggcatccttcacttcagcctccgggggcacggcggaggaatcttggggaggcggcatggttgatcgatctcaatcacgcatattctacaaaatgtgatagaattgaaagcagggctcactgattgatcaatccgcgcaacaaggtagtactgaaacaaaagcttaacgtaaaggtgggaggggcggctgctatatactacggtagcctcaacgccagagatttcacgctgacgacagagatgggcagatggtaatatgacatgcatctcgaccctccatcccggcactgagtgcaacgtgggacgtatcttgactcgacttggctgatagcaccgtacgaaacgagctcagcaaacggctgaccgtctccccatgccggaaaactgggtagttctccaggatgggatgactagcagaagatcgttcggcaaattgctgccggccatcacgaaataatccacaattgccaattgccttggagcgtatggaagttttaaatggcgcatgcgctccttgaaacggtccttctcgcaataccaaggccaacgagcctgcttgtctggatcatctaggctcggggaagaagggtggcgatgcagtgctgcagaacaccctgtctgcccatatcgcgaaggccggggcaaccaggcggggcatgttacatcctggccctcacttgaaaactcgaacagagttctggggccagtggagaagtgctttgggatccgtgccgagcgcattccagtgtgcaaggcggggatcgttgaagcataaccatgcgtccgccgtctggctggaatgtggccgcgacggggctggcttcggatcaaatcgtatcaaacaacggctcccggatcttcggtcctttgagatgaggcatgcgatgagtatggcctctcgtcgcgctgctgtgggggttgggactgtggctccagtcgcacagacgcttgggggtcgtcctgcaccgggacatagtctcgtcttgattcgaagatcatgcccagatttcgataaaaggtaaagtatcgcataattggcggccccgggtccctcaggcgaaactggccgtccgcttgagcagcctcgctcctctgtctcaacctcgagcggatacagtagccataaagaccgtagagaatgagagggggcgcgagaaagaccaagagcgggagaagatctctgagaggcatgttggcgagaataagacgtttttgatcaaggcgggcagtgtttatcgtgagagaattgaaagaaagccgggagatggagagagggaagcttcttgaatatgtgctgacagcggaaggtacctggcagccaatgtgggaaggagcttgggagacatgggcatgaaacacgcccatcagtctcctgggtcaatgagtcagaagccgccaagccacatcaccaggactgaggatgtttgaataggaattatctacatgtacctagtatcggcaatcgctttagtgtggccttcatatcaacaagcttaaagtaaaccttgggctgaagatggcaaagcaggaaactgggtgacattaaaatcgagcactccaacatgaagatgcttgatttcgagtctgcgaccggtatattcagattattgagcgatgaaaatatatagagataatataatacatgttatcaataatctcattttatactaatagattattctatttgtcgtagaaagcggtctattgatcgctgctcttccatcagatgcctcatttctttagtcacccacttagcaggtcaacagggcaaatcgaggcagtgatcttcaatacccgtcctgggaaagtaaaaaatgtggcaaggtcgtaccacgctgctctgagattatccagaatgatgtcacatgtgtattgcttgttgacctcccatgtaaccaacagatggagcgatgaatactcgtcgcgcattgtcgtgagaattatttgcatactgaacaatgcacatacatggtgaatttcagagtaatagaacaagatattgatttaaatggtctttggcttgtgtataagctgatcatagctacactgagccaaccgcacacgcgtgaattccgacactcacataacctgggaatcaaaaggcggctctcgacggtacactagtttatggtattcataggttctcgcgactttttcttgtgattagagtatctgcgacagtgcacagaggagcaataaacggcatacgccagagagacgctctgctacgcgccgcgctcatgcttcatgacggtaacggaaaccagtggcattaaaacttgagtgtgaaggcatcttcgatacgtgtcatctaccctctcaaatgatagatcagttttacgggagaggcaatgcggtttgtgcccggttttgtgcgaatggcatccatccatcgaatgatttgggggtcggccgtaatggcgagccacgtgagggctcgataccactcaattatgctgaccacctggtcgtacatttggcttgctcctcggtactactctcatcctggccggcgcctcacccaggttgcgcgacagtggcctcgaaataaagaggatatctgatggaatgcatcagagtcggttgaatacttacacctccagaagctacacacttccctggacacgaccgaagctcctcctacctcttgctccagctgataatgccttgatcataaatgaacatcggtgctgtaagggatggttggccgtggagagttcttatttgtctagccgtgaagagatgcctacctgtactttgatgtagagggggggccgtgttgaatcctccccaaagtaccgcttctcagccaataacgccttgatcacaaattcatattggtttcgtaggggaggattatctgtgggtgcgtcgtatttttcaagtcacattttccagccgcggcgaggtgtctgcctgtgcattgacataacgcctatctacccaatgttgccccgacctcctctcggttccaggaaaactcccaacagcgactcaaacttatatcaaagaaacccgatgtgttgataaaacaacattcattaacccatcatgcaagtctgaaggcggccatggagacccggagttcagttgctagatcgcagcccgagtcgtcgggacttcaggctgtactcgatccaaccctcgaggtaacacctgatgatggaatgattcccgtcagctctggagggcttgcgaagccagacgggcagtcccagtccgccacgctcgtgccaactgaggagaacatcaacgaaacgcaaaagaggccacggcggcgacgatattacatcatcggcgccgtcgccgccgtcctcattattcttggagctgtcttaggcggagttctcggctcgagaaagaaagctgcgacagaagagtactctacaacctcgagtatagaggtatcaccctactcgcgtcttgcgttctcttcgtggcatgattccaaggggttcgtgagacacatattctaccaagaggcgaacgggacactccggtcatatatgtccactggcgtgtccgctagcttggagtctgtggagtacagtcggtgggagcaggcgacaaatctcagtcccgactaccgagcacgaaatctctcggggttcgccacaggcctgacgattcaagattccaacggcaatgggaatgggaaagctgtcagtaatgcatgctccaatggatgcagtgtgatcaggatgtgctaactatcaagcctgacttcagcttcaagtagaggcattttacctcaataccacgaacttcgtcaatgctataaattacggccgttccttccaatacatccgcgacagcatcaatgacaaagactaccaagcctcggatggaagcggtttggccgcgtactggccctatgtcttgttccaatcccgcgctgggttcctccaggtaatcaaatatgcctccggctggaccacacagatatcatcaataaaaccaagggaccaatccccgatcgccgtcgtccccacgtccaggaactacacggagatttcaactgcgggacgaatagcagtgttttacgaaagcgtggactccaagttgagtgtgtgggaagatcctttgggcatgggccaaggtacaaagtttgcgaatcaaaccgcgtggaactcatgtacgccattcccttcggcaccactaaactcgccatagcatatagcatggatagtcgctgaccacgtatttgttagcattccctgacattgacctatacgggttgtcgatcacagcactcgccgtggcagcgtcaagtgatcattcagacgataaaatacatacgtttgtgttgtatcccgaccggggtggcaaaattcaacaactacggcgagaaggggcggagaacgactggcagttgtccacacctggtgccttcaaagttgccgatccacacacgagaatagcgtgcgtcacaggcccaacatgggtgaacgcgttgacggcggctgatcagccaaacgaggtgacggacgttgatagactgcttgaaccagcttcgaacctaaccaggtgcgtgttcctgagtggcggcaacttgctggagacgcgattagacggggtagactgggcacccccgatgctggtcagcacttcgtataaggtcaaggtctcggatagcacgtcttgacgttgtctgtcttccaaatcccaaaaggctgtgtcagtgagctcagaagttgattctagctgccagcacactcagcgaggccacaacttatatggcagcaacaagatagacttggtatgagtctgaaacctctcatcgcaatgagaacccaagatattaatctttttaatcaccatgggacttatttaatcggctagatagtctccacaggatcgctcctactcttcacgacataaatgtccaatttttctcctacctagatttgcattgcatgtagaaacgacagaattagttgcagactcgtccgcgggctggtacatcaagctgacgatgctacttcttggccccccaccgtgtcctaagaacactctcgtattccgtctcagagcccacgaattctacaatcctctcgtccacgcctcttcctctcaaatccatccaagcccttgagtaaacggcacaggtggctcattgatacggcgacagcccaccatgtcagaccaggtatccaaggacgcagccctcatctacaactaccaccgcctctcccacacccccgcgcccgccgacgccatcttctgcctctgcagcctcgacacccgcgtcgccatccgcgccgcggacctctacctcgccggcctcgcccccctgctcatcatctctggcggctccggcgccctcacggccaaccgcttcgacgagccggaggcggtcatcttcgcccgcctcgcccgccagcgcggcgtcccggagtcggccatcctcgtcgagccggcctcgaccaacacgggcgagaacgtccgcttcacgcatgccctcctgcgcgagcgggggttcccaccgctcaggtcgctcatcctggtgcagaagccgtacatggagcggaggacgtacgcgacgttctgcaagcagtggcccgacgagggggtgggcatcacggtgacatccccgcagtatgagtttgaggagtactttgacgcggacaacccgcgcgagctggtgatcagcatcatggtgggcgatctggatcggatccgcgagtatcccgccaaggggttccagattgagcaggaaatccctgctgaggtgtgggaggctaggaacaggctggttgcagcaggttatgataagcatttgccttgatagaagctccgaattttgttggaaatgatgatttccgttagaccccaatacaaagctacttttttgttccttttgctgttcccgttatgctattcacagtcgccttgatgtagccctggaagctttcaaagatgactgcatcgtgaccctccatccaccggcacccaacagacaggtcatccttcgtcacacgcactcgaacctggaaaccgaaaacaatcgccgacggctctttctcgacttcttctttgccctcctgctcttcaacttccatttccctcttcctcttcctcctccacgcacggttccacacattcgcctctgcccggccaacaccctcaagcctctcttgatcccactcccagctcgcgagctccaaacctccgatgtgtcgtcgcaacgcatcagcaaactccccaatcttctctgggacagcaatcttcagtacctgctgctctgtagccggagggaggtcaatcttcgccgcgcccgccttggacgtgacacccctcgcgacgctctgctccggccgcatcgcctggaaactccaccccacagcccaccgcctcgtcttgctcccctgcacgagctccgtcacggcgtagttatcgatcccttccttcttcagcctctccaccagcttcgtcgcactcgagaggaatcccaccatgcacgtgtaccactgcacgcgctcgcggagctccagggactcgtccaggatcctgccgacgaaggcgacctcgccgccggcggtgaccatttccgtctctgagccggtacatgccgtgaatggcttcctggatttctgcgcagcgctctcgaggagctcgtccttcgacgcgtaaaagggcgggttcgtcatggcgaaatctgcagaggagagctttgcatcttccagagggatcatgggatcgtcttgcgtcctggcgaggacgttgatgcggtgtgtgagttcattcctcttcacattcccccttgcgtattccaagcttttggcatcaatgtctattccccgggatgttcgttagatgagggtgacccgattgatgacgagctgtgtatttcatgtgcttaccggtagcgacaaaggaccaaggtcgctgcgtgcaaccgaggagagggtagatgcagctcgcgcctgtgccaatgtctatcccgacggccttgcgtcccggtttctcgtatgagcttgtatcgagcaggttcttcagccataatatgtagttgtgcctgttggccacctacagcgtgtttagctgaagccggagccaggccaaggaaggtcaattactcacaggcggacagagacgatcatcgggcagctcgatactaagatcaaagtcgagcttcagaagtgtctttgtcaattgcattaccgacgccgggtcgtcaaagtcgagctctcgccccttcagtctggaatcacagtgagctactcggtccagagacgaggattagagggggttttgcctacactgcggcgaggtcaggatcaaggcgcccgaggaccttgaagtccggaggacttgcgtacaggtccttgtaatagcggtccttggattcctggtcgttcgccattcttttgcgtttctctctcccgtcacccgacctttgtatttgtatgtaggccgcaagatttgaagccgtagctgaatgaaggcgctgtaggtcagtgacgtgagaggtggagcaccaaagctagagcttccagcagctcaaactgatgttcgtcaattgctaccctaaaacacaatattacaggaaaaagggcgccagaaagagagaaatgtgctacaggccgccagacaattggttgaccaaagaatggtcaagtacccgtgcaattgagaggtgaaatttactatttagctgtaaaatctgaccctagatacctactcacccaactaaagaaagaaatgcttcgtgattatcatatactcattgaggaaatccatcccttctcctaccacagcaggattcgccatcgccagccatccaaaatcttgatgtccctctcgtcaagctccgtgtctcccatctctacgcgcgcaacaagcctcttgatcctcttgtgcatcgtcctcgcgacccgcagcgagacctcgttctggaaaacgtagaggacggcgaagacgaagaaggcgatcttggcgaagctcccgttacccaggacgccctccttgatgtagtcgagcaggcccttggatttattgaacgcgtactcggtatcgttggaggctgccaaggacgcttcgtcatcgccccggcggaagatgcgtcgcaccaaagggatgaatgatgcactgttgatcaattcgtcagtccaatccgttgaaccatagttgtttggcccctgctgaggagtctcccagctctgggtttccccaggaggtccgaaaataacttacatcgctccaccaagaagccatttacgccagcggtggttctccgcggatttaaccatggcctttacctcggcctgcagcgctacgagatcattgagcaccatcccctgctgcgaccggatcctcgactccaggtccagagctaccttgctcgaattctcggcgcgctggcgcttgcgctggaggctgagatactcctgcagctggaactggcagcggctcttgagggacgggacgtcggagggcaattgggagacggaggtcatcatgggcgcgggagcatagccagcattcgccacgggtccgtagccgccgcctccatagccactgtcgtagacgccgtcgtgagggccggggccccgatatccagggctggtggcgtagttgttggaggcccgcggcacctcattcatgctatgggggtggtcagggatctgcgactcggggccgagcttgagggcgatgtttggcacggagctcgtgcgcgtgggcttgacggggccgtccaggttcgcgagagacggcgaggacatgggacgagggtccatcttggccagaggcacgttgccgatgctgctcatggtgggcggattgcgcgggaggagggagatggggagacgacggcgacagcacggggaaagaggagcaggcagggcgcctgaatgaagggattacagttctctatcccgcgggctcttgagaggacaggacaggacaggttgtggaccatgcacgagcacaggaatgggcgacgcagcgatgttggtcggtcacgttggacagaattattcggtggctgggagaagcagaagggcggcacagcgggttgagccgccactaactgatgacgatggtgcatgcgatttggtggttcgatgcaccattaggagcatatccattgtttacataagaagctgcataaatacagggctcatgctgcggtgacgtgacctgaatggtgggagggccaccgatcatcaagggcttaacccactaaacatgcgggaagtgggctcaacggctaagcggggttccagcgcccgctttcagcaatcagccctcttcatcccatctcaactggcctcaaatgttccatgggccattccatacactccaatccaagcttaacacgcatcaacttagataatctttttatacgatggcagtaccatttcaccacctatttttgttgtctcgtcattggggcgtgagcgtattgcgaagcacttggcacacccaagttgtgatccaagctaatagatggtcatgttacgatattcacaatactttctcatggcaagagacaactcagacaacccaactagagcgaatcacgctatatttacggttgaatatactgatcatgacgcatttcactgcagccattgagaagagatgtgaaaagacaccacagcagtttcagtctaagctcgctaccgccactctcaacgccttgctgccacctacaattcaacctatcagaccatcccatccaagataaaacccgggagtatgattaccacaaggccaagctgtcagagattgttcacgtcttggtcctttagcaggtgaacggcctaggtcccgggatcgtatagctggtcacggggggccagtagatgttgatcgtgacgccggggtcagtcgactacccaataagtaagcaactaatcatcaataaacaaaagtttctagtgtgtcataccttgtacgcgccgggaatgctgacggtcgagggcttgccggtgccggtgcccccaatcacgttgatttgggcgcactcctggtagaactgcgcaccgggataccccgtggccgagtgcagggccagcatctccgcgcggaggaggtactgcccggactcgatgcacttggggatggtgatcttgtgcaggccttggccgttgatgaccttggtcgtcgcccactcgccgctggagtcgagcccgtcctcctggatcttgaaccagcccccgccggcccccgacgccgtcgccgcgttgtccaccttcttgaggtacgcggagacggggcccttgtgggtcgagtccatgatgtcgttgggcgcggtgcccgtcgagctgagcatgtagcgccagacggccgtgacggtgtctcccgcgttgacgttgatgacgaggttggtcggcgtggtcgggttggggggcccgttgcacgccagcgagtccgaggtgacgtcctcgatgggcccgttgtaggaggggacgcggacgccgttgccgatgccgtagtttgtccctcctaccgtgagggaggagaagattgtgtgtgcgctgcaggcacttgcggcgaggagaccaaggaaggccttcatttttggaatttcaagtaggaagcgggggaaatctcaggtttgcagattcagctcaagaaggtctgttcgcttgattatcatgagatgaaatatctcgcggatctacatgagtataagtaggtaggttcgtagttccctcaaggttcgacccctggctcatccaacggcaaccacgggagcaataggcatgatccgaatgctgatcggtgaaataaactctcgaccaagttacatttttggtcagattctatccagattcctggtgaccatgaccgatacggcttgacggagcgttgacaacgaaaggccggagggtgatgctccgtgcacgaccactcgcttgcatcctcatgcgaaccgccttcagatgtctttaagaagggatcgtccgaactttggaataacctcgtcacattgacccccacgttgacaacattcaacttaaggtatgatccaagattttcccagaaaatttcgacttacaaggcatggaaatcgtcaagttccatgtcatcaattggccactgacggagattcaataggctctgccaagtcgggtctgaggttgcactcccgaaagtcatgtggggaaatatcccaccctccgcgtttatttgttcttttccacatggtagccagataccaagtccgcagattgaacgtcaagtgactcgagtcggcggtagggaagactgacgaatccacagtggctccccgagattccggcaccagcagtcaaatcgtggcatccccttcgctgctcagtggatcaaacaacctggtcaatcccatatcagaagggagccgggcctgctaaaaataaagataagtccgggaaaccatatttcctgacgacggtacaccatcaattgtgattgcaggccggtcgagtgctcaggccaattactggacctgacgatatcaaggttcatcgcgtaagcgggtgagattcgacgccgcggcagatgccgggtccagcgaaagacatgaagcactattaatatgaccaggtgtcgttccgccgtactgagcgtcgagacggccgcctcgcgacgatcgattggtcaaggcgtccagaaggcacggagctctgaccagccccgggatggccccgttggcgctgacagaaccatcaggattcaggcgtcctctctcctgctgtggggaacagaatgggctccattgcttccccgtatcaacatcagaataggggtatcttacagctagcgtcgggaaggaattcatgcgcgctgtggagaagagcgcccgtaggttccgaaacaatgtggtcggccgatcggcattaggggaaaccaccatcatggctgcaaggacactgggcgtctggcctcacagcgcggtgcccctgcaggtttggctgcgtgctgcgtccctttgcatggactacgggtgttcgtggagcgggaggtgttcggagtttcagagctggttgtgtagcatcgaggcctgatggggacccgattgtcgctggcacgagaatggggagaggcctagcccaccgaggcccgaaccggccttgctttggtgtgttcggagattgccctacgtatggcatgcgcgtaagaaatgtggttgtggggagagcagcaaaaggcttgactcagctggatttgcagggcggacggccgtatctggaattacttcacgggtcccgccattggcccggggaacaaccaactttgctgccaacccaaccagatgtgatggtaatttgcgacctggctggaggtagcatccagcacagctgaggtcggcaggtcgccaagccgtgacacccaagacggacggactgcagctgctggactcgggaagtcacgtcatcaagcctcccggtccaggaaacggccaggctgaggctttcaagggagcatgatgatggcaaccgccgggtcgaatccctgcatcccccctcgggcccgtcccattgtcacatcgattaatgtaccaacaagtaccctgtgcagcctgtcgctaatttcttccccggtgtggcgctctccccaaattggagcctcgccattggccccccctccttcatatcgcgtctgccgggcaaagtgacaaccgagaaagctgcgggttcccaggctcaaacaaccaacctgcgtgggccgtcggagcaggccgcaccaaccgtgggctaagatggacgatggcggctgcgaatgaaataaatgcctggcctctcagctcggaacatttccgtatcacacgggcacctccaggcgctgcaaggcgaatggtaagcgggctagtgcgagccagccaaccccggataatggtggacgatcctgggatggatgcaagccgcagagttgcacgacacggccagctggagtagacggcaggggggggcggtcgtagaaacggccgttgatcgggcagctggagcgccaggccctcgatctgtgtacacctcagattggggcattatcgcctacagcgcacgcgtacagtggctgcagtgcagtgatgagctcggtctcggagcagctgaagcaggggagcaccgtcggatacggccaacaaattattctccccaccctcctccctgtccttcccttgcgcgctcccactgcccagaaacgctgcatcggccgattgcagcttccggaggcgccgcccgtcctcaggtagcccttaatcatgattggctagtagaaaggctgcccccactctgggattttcaccgtgtgggccttgagtccgagacatttttttttctgctcatggcgcctgaggaacccacgcgtacgtggtgtacgtggtgggttctttggtatttctgatacacaattctgtttgctaagctgcccccatcagatcagcggtacgcatcgacggtgtgcggcagaggccggccgggcaagtgccgtggtgaaggagcagaatctccagcatgttgcaaacaaaccgtataagacggtcggggtggatatgcgggatccgagcagcttgagactggaggaggggaaagacaaagctcttccaccgcccacccagtagagacacttcggaccggagcgtaacgtgttgtgtggtgacgactcggctgatgctgacactgagcacaccacaaatgaccacaccctgtgcataacatgatcggtgagtgcagatttacatagagagacggagcagagcgagcacacggacctccttccacgccccgtcagtgtctagtgcacccagcgacggcctcttagccccgtgggcgcgagagatgaacgtctttctcatgatccggccatcgctcgtatgcaccaccctccctggctgagttaggtaggtcggtcgggtgttcatctggcaggcgggtcggtgcgtgcaacgcgactagcgtgtgcctacagggagggaggatgcgcctacagaggggatggggaatgccggcacggcctgccagctgccgtagggcgcctgaggcagagaggtgccccagcggacatcactgaagaggcgggctgttgggctggggaaacgttcatcggttcctgccttggggcgggtaagaatttattactagtagtcgttgccaaacgggaggctcctgcgcgtcgccagcaaaacatccaggccggcaacgctaccctcagtctattcttgcgacctccttctccatgcttcaggctcccacacctccaagccctttctcacgagtccacagtaccgccgtcgccgcctccgccgcccgtcccacaactccgtttcttcccctttggcctcagcctggcgtagcttccctaaggcaggcaggcctcccaatctccgtccaccccatccatcccttccacctcctctcctcgctcagacagactccatctgcccaacatcactcgacacatcccaaacgaatatctcaagcgtggacgtgcgcagacggctcacacaggacgcgttgcgcgagatcccgaagcacgattgacgggttccttcctatttctggccgggtctctactgccccaattcctgtttttttttttggtggccgaggcgtattttttctttttgcgttctgcgttggccgtagctgaccgccgcgtccctggccgcaagccacggtaccctgaatctcactccggaacccacggttggtagcgaacaacctccggccccccaaccacccaccacctatcaccattcagctccctcttccacctcctctaccacccaggctcggtttttccctcctcccacgctcgtcaccctcctccgcctgagaaagaggaggatattctaccgcctcgcatcgcgtcgcgtcgctgaattgcccattccccgcgaatttattttttccttctcccccgcctccgacgttgcgcgccctcaaactgatttcctagcatgtcgtccggcgttgtgcggtctacagccctcagggccggcggcgcgtgtgtgcgctgccgcaagggaaagaccaagtgcgtctacgagaacggccgcgccccgtgcaagaactgcgcaaagggcatgcacgagtgctatcttccctcggagagcatggctcatcaccacggccagagtcctgctcgccattcgaatgctcacagagcccctcgagaatcactcccggcttccggggccggcgctgcctcagaggccaggcagcctacagtgggctcaggcggcaccagcgccaacaggcacgtccagaccgccgccgcagacaagtgagtagcgccaatggcccttccttccctctcttgctcgccccatcttcatgaccgagtctccttctcgctgcctcacttcacccactgtcccagcccaacagccctcacttccaccccctgcaccaccactggttttttttattccgctgccttttccacccacccccaatccccctttatccagccctgcgccaacaagcgacatcatcaccaactcgagcatcacctcgccttgccgcccccaacgtgtgacgggacttgcagcggctcggctgctcatccctcgccacatcactcccccatccccctcctctcgtcacattggctcgctgttggttgagtccatatcagcctggcgcatccaccaatccagtttccccgtctccgggttggctgctcctgggccgggttgcattagggcacctccgcaaccaagtttccaatttttttcatctcaccccccgaagcccctccacaatttccacccggctgaaagtccgtgccgaggattttggtcacacgtttttgctttcctgctccctgcccgtttgtccccttggctgtcactggtgtttttcgtcccccatctcctcctcttccccgccccgcaagcgcacattcattcccacgcacagccaccccagtctggggcactggctgttggtttgctagtgttgctccgagatgtccgcatgccacctgcagcccagctgcaaatatcgcgccccctctcgtaccccttgtttctgtcgcgcagatctgaaccccccggctctcggttatctcctgctaacctcgttacctcaggctcaccccggagctgatcgctgagtgcgagcgcgtcgtgtccaagacgttcccggcttgtgtagccttccacaagccttcctttgtacagcagctcaagagtgcctccttggagccatctctcgtcttcggcttgctagcctgcgccgctcggtatgactccccaattggccctaggggcccttcccgtggccgtctaggcttttcttgtgtagctgtcgccggtggaaccagctcctgctagtagctccctagctcctcgtcttttggtgatgcgttcatcagaggaaacaggacaggatccgcccggcatcaggacttgtgtagaaaagcggtctaaagtcgaccaatgcgctaatatcacgtctacaggagctctcacgctttgatccggcggtttggcaacccaactacagctgccgagaacttcgcggccaaggccatcggcctcgtcacccagaacctagaccaccccaaccttgcggacattcaggcgttatgccttcttgtgatccacgaatggggctctcggaacgcggtccgtgcctacatcttcctaggccaggctgcgcgcatgctccagatgtacagcattctcaacagccaccggactgaccccgaccagttcctgcgcgatgagtccttccgacgcaccctgtggctcatctacattctggactgcttcctgaccagcacccccgggcggtaccctgctctcaaccttcgcgacacggctgacgtctctttgccttgctctgatatcaactttgcatttggcaacgcagtctacgtcaagaccctcgcccagcagcttgacccagttcgcaaccccgtcacccagcctcccaccggcgaggtcggcgagtttgggtacatcgtgctggcatccaccatctggcgcgatgtcgtcaccatgctcacggggacaacccttcagaacttccgagaggagacgtgctctgatctcatcgacaagattgagatggtgagagcatcgctccccatgcagtttgtggacaagcctggtcagatcaacttgcacatgaccatgggatcaggctacacatttgccatgctccactgcctgctgcactgctccagcatcttcgtccaccggcggcgactcctgcaggaggtcacagcacccagcttcaacattgagggattccgcatgtcctccaagtgccacgatattgttgatcggctcttcacctcatgccacaccatcatctccctgctaaacgccgtggagacgggagcggagaaggaccacctcacctgcttccccatcttcatgctgttctcgtcctttaccgccggtgctacggtcgcttatctgtccctcaagggtttgacaccatccaatgcggttgagacagccagccacattgtcgaggacggccttcgtttcatgaccgagggcacagataactggccactcatggcaagctggctacgtcacctcactgtcatgcagcgcgtgctgaacaatgacgctgcagccatgaccgcagcccggcacaattctactggccacaactccctcggtggccacagcagcatcaaggaggaggtcgcatcaaacgccgacacctcggcagatgccatggactacgaccctcatgggcagagtggcagcgtccctcctcagcacgcccctcccacggtgcctcttgccggtcccgactcggcacgtgctggtagcgagccacctgtttccattccccgccgtcccggaatcaccactattaatggcaacgcaggcgttggggccggtgcaactgtctcgcctcccccgcctaattctgcaggccagtatccattgtacggagctgagggcaaacagcagagcccggatgtgcctccaaatggcacagtcggtcccccgccggaggcacacactacaagccaggacatgacggctcctgagctctgcacagtctttgagcgccaacttctggaaatggatgatctggccgcatttatgggtggcggtgtctgataacgagagtgacatttcttgtcgaccgagtcttggctctatcagggatggcaacctgccgctgtgctctaccattcggatgggaatcctaggaaggggcaactccgggcaaaagccatgggcaggtgaaagcctgcctattaacgaattattcctctctattcctttctcctccgcctgtgatcacccttcatatcatctttcacgcgcctaggggggcggatggatctgttttgtttttcaatttctttttttatcttatggtcttggcagccagatcaataagctttgtttgtaggactagcaacaacttcaggagtgggattagcgataccttggaatgggatgggcgttttgggggggtacgggatttagatgatcttgatcccaccggtcccaaagggggatgggaaatgatattgatgagacggggggacttctccatgaatcgtccgacttggtcggaacgacgtgtcgtgccctccttcctttgacaggagggggtttcggcgcgacgtgtgttttttttttcttctttttttttctttttaggcatggcattctcggtcactcgaatgatcagtttgatttttgaggcttgggatttttttgaggcccgtctgtcagcggggagttcatggtacaggtagagaaaataattcacttcaacgaggcttgagatttcgaaaccttgtaatcaccctggatggcttttacatcccggatctacggtgaaatggagttcgttgcaacgtctcaaataatgactgctccaactacgaaggaaccatgaagagaaacttaagataatacagaaaccgcggaaggcgctgcgaagtaggtaggtagggtaagagaaggtacacttttgcatgctgaatacaatgaagccatccacagcgacagagcagatcccgctcagtcggaggagctggaggacgacgagctgctgctgctcgacgagcgcttgtgcttcttcttgtctttcttgtccttcttgtgcttcttgtcctttttgtgtttcttatccctacaggtccagctgttagcgatagctcgtagctactggcacgttcgagggaggaacctcgtccgaggaggccccccccagcgatgatgatgatgacaggtctggacactcacttgaaggcgtgctcgatcatgttggcgcccacggccccgaccgccccgccggcgatcttgcccatggcgccgccgcccatcgcatgggcgccaaaggctcccgcggcgccgccgacgagggttgcgccaagacctcgctcgtcctggcccgggggtccacctgggccgcccgggtagggacctggctgctggtggccgccgtagtagctgggtgcgccgccggggtgctgttggtggtgctggtcgcgctggtcgtagccttgctgctgctggtgagggttgtagccttgctgagggtagccctgctgctggccgtagccttgctggtgttggccgtagcttggcgggggaccctggggctggccgccgtagtgttgctggtgctagttaccaaatgttagtttgagatggggatgttggctgttttgacgatgggattgcggatgaggtgatgatggacgaacctgctggggatattgctgctggcctgaatactggccctgttgagggtactgttgctggcctgggtactgctgctgtgggggatactgctggccgtactgctgctgcggctgtccgtagccttgtgggggctgctgcccgtagccgccgccgccgccgccgccgtagtagtcgttgttggacattcttggggagtatgtaggctacgcgtggatggggaaggcaggtgtgaaagggaagatcgaggacagatgccgatgcgacgggaggtgcagtttggatgggcggatggatggggtcatcctttggtggacagatggcttttatgaacaaggatgacggccgacacggcggactgcagactaagctcgggaagagggggtttcatagtgtcagctcagctgtgagtatggagcaggaccgtggcgcagcagctgtactgtgcgtcgctgggagggacgggacgttggatgtcaccggttctgagtggaaggatcgtcggaaggtggcggtcagccgttcgtaggcctccaagccacatcccgctggtagaacaccacatcacggatggttgagctgtgatgctgtgcctgttaattgccacgggacacgcggttacacttattcctgtatgttaggggaagtacgtagcaggtaggtactaagcgaacaaagttggtgacggattggagtaatggatcgaactgagcccgtggtaacgcaatagataaaccatgtgcgattaccttagtagatatataagcacgaacctattgttatttcttgagacattgagccattgtgcagttctaaacgctgcgtgattaatgtcggtgccatgtctccaatcgttttgaagggtgtgtagggtagggtagaagaaattacaaattgatgagaggtggcttaggtacctaggtaaggtaattataagtagagcacaatctccactgatcagaatgctttaacagcaaaatgatatctatcattcaataatagagacctggacctttggtgcctcatttcggttactcggctgatcggtaggaaccttgatccacggcacacttgcttccacattatctgtgcttccaactcgcaacacctccagcaaaaaaacccaaaaagagaaacatacaacagcaggtattcgctggtcgtcaccgacccaactactaatccgcccctcatccgtttaactaggcgagagcggacgggatcgcgtgttttcgaatgggtatggtcgtatgtggtggttcaagctatcgtgggagctatatgccctagttccccaccacaacacaaaatgataaaaatcataaagtatggtattccagctaaaaaggaaaacatacaacagcgggtattcgctggtcgtcaccgacccaactactaatccacccctcatccgtttaactaggcgagagcggacgggatcgcgtgctttcgaatgggtatggtcgtatgtggcagacagcactgttgttgggatagaagtagaggctgcgatgaagaggtatagagatctattgccatcatgttctattgtagtattcgcgtcttgttctatatacctcccccgatctagtcaaaaatacaggatatacatgacattttggtcgctgaatagtacagcttactcgcgatactcgcccgcatacaacagatcgccgggcttgccgttcatccgctcccagagagcgcgtacatccccatcctcaacaatatccctttcctgtttgtaggccgcgatctgggcattcgcggtctcacgctccagttgcactgcatcactgttagcttctcaactctaaataagtaattggtctgggagtcgtgtcataccatgcagatagatcgccgcgcgcttccccgagaacagcgcatgggggatattggtcgcaccgtctgtgttcgcatcgccaaccgcatagacaccggggatattggtgatgagacctttggcatagtctgcagtcagtcgtccaccgtccaagcgcacacccatatctggaccaacagagctcgccagttcatccgtgaatttggcgaagaatgcgccacgctcgactacttccccgcctgccaagtgcacacggaataggtcatactcagggtacgtcggcagactggcatcgccggcggaagcggtacttagacgctcaatgctctcaatggtctcgttgtagatcttgatcttcctcagctccaggtacgtctcccacccgggcccgaagtcatcgtcggcgacggcacccatgtcggggacgttggtgccgttgacaaaggccacgacatcctggttgagcgtggccatctcccgcaccaggcccgggaccttgcccatgggggccagtaggccgaggccctggtcggcgtgctctttgccgtcgcaccaggggcaccagtagatgcccttgccccagttttcacggatccccggggtggccgggaggatgtcgcggaggcctgtggcgaggacgatcttgcgggcggtgagttgtttgccgtcggttgtgacacggaagaatgtgttattggcctggggctcaatcttggtcactgtaccattgctcatctggacggtgtcataatgggacagctgctctcgtgcaagccagcgatagtacgccggcgtgatacctggtggtcctccggttagtaacaataacgagaatcccagtcaccgagagtcgcccaagtgaaacacataccgtccaggccgatcaaatcgtgtaaatgccgggtcggtccgttgcggtacactcccgagtcgatgaggaggacattcctcctcacacgtgctaggccgctgagagcactgagaccggacggacctcctcccacgacgatagcatcgtagtcgcagccggaggcgtcaggggcctgtctaatgctcacggctgctcctaggacgtgggagacgcccagggtaagcgccgctgcgatcagcttcgccaacattatcctgtgagacagaaggaatctgtatggctattttgctgctccgatggggtcgattggatatccttactgacagctgcgcgacagagacaaaaagaagcccataagatctccaggacgaccgaatgcgaacggcgggaattcccagagattataagcttgttcgatattgccatcttcgtcaggttcttgtgtgagacatggcatttgaatttaggatatttccgcatccgtccgcttggcgaaggtggcataaccaccactgcatgttcttgtgctcttcattgtgagatgtgagcgaagcgatccgtggcaacaggctggcgaagacatcggataatgattaagcgagacatggttgtcggcagaggcaccaggttggcgagcactccagataatgattaagcgagaaccgattcgcgagatgctgaaattctaggcaatgagcaatgtctcgaggtgggttggcactagacaggcagagtctcggacattccagtgtagctttgggtttcttgactcaagaagcgaaaaagaccatggtcaatccgcatgtgcaaacggatggcgcttgggttcattgcggcggatcggcacggcagtttcgcatgtcccgacgtatagcgaatggcgcgtaactttaatgcaatggcacgtggagaacggactccgcgaagcggaaagaggaatcaggccaatggatttttcatatttccgcattactgggttggcggtactcgtatattatgcacgagggggatgcaggatacgggcagcatcctctggcccagaggtaggccaggccagacccgaggagacatcggaccctcttagcctctttttgctccctcactttgttttgcatctggccttcgtactgtctctgctgtgtcctggccggttcccccttacataagtaggcgaaatgaccggcacccaccaaaaacctccgccgggacccccgtcattgtaccgccggcaggcatagcaaataggagcagtggactgggtacgacatgaaacaggccggccttgatcgtagagcacgcagtcgtcatctacatcggatagattgacagatgtacgtggcggggtgatgccaggtttcgagaggacggacaaggacggagggttggcaggctcgccagaatggcagatttgagcgcgggcagatttctcggagggtttcgaacatgatcctagtggacgggattcgagccaaggcctgcagctcattccgatgaattccttcccaagccaaatgaagcaaacggcgtcagcgggcagatgacatagccttctgttcggcccctgctgattggccacaacttccgctgacataatacaccccttccactttcctgccgttgatgcagatcgccaaacgaagcgtctttcccagtggaggaccggatcggaatacggcgcatctgcctgcatttgcctgcatttctctggcggtgcccctagtgcctcctatctcgtcgcagaattctgcctgcggttgcagtcgccgtcggggctaagaaacacccgaaccgggctcggggtgacttgaacacgatgggcgatgcgaatctcgggattttcataggtatatatatagagggcaagagcctgcgaagagacgaatagacagatcattgacttcacattcctcataagcgagccggcatagcatcagtttagcctttcttggattttttcatacctcatctcaactaataccagccctcgattcttcctccgcatagcatcaacccttcccttctcttcttcgccatggctaccgtggatatccccgagcctcctgcataccccatcattggccatgccgctctcattgaccccagctatcctctcggttcaatccagggatttgccgacaaatatggtgagttcctcttctgcttttgccctaggctggtttgttcgatttaccaataactttgttgtaaccaggcgagattttccgcatgagatttcccggctccaacaacgttgttgtcacaacccaagcactcgtgaatgaggtctgtgacgagaagcggttcaagaaggtcgtcgctggtcctctcaatgtatgtgtcttcgaccttgtcctgcaactcctgcatccaaacgggtgctgacccgtcacccacagcatatccgccgcggcgtacacgatggtctcttcacagtaagtcagctctcatcctcgttgcagagagtcgcggctcacacagctttaggcacacgatggagaagagccctgggggattgcacaccgcgtccttatgccggctttcgggcccctcaagatccgcaacatgtttgacgagatgcacgacctggcaagccagctgaccctcaagtgggcgcgtgtcggcccagacacccatgtagaggtatctgacgatttcactcgcttgaccttggacaccatcgccctctgctcaatggggttccggttcaatagcttctactccgaggacatgcaccccttcgtccaagcaatggccgacttcctcaccgaatgtggcgagattgacaggcggcctctgccgggcatgttctaccgagccaaggatcagaagttgatgcaggatattgagattatgcggagcaccgctgaggagatcgtcatggcccgcaagaatggcaccaagtccgagagccacaacgacttgctgacggctatgctcgacggcgtggatgccaagacgggcaagaagatgaccgatcagagcatcatggacaacctcatcaccttcctcatcgccggccacgagaccacatccggcatgctctcctattccttctaccagatgctgacccaccccgagaccttcaccaaagcccagcaggaggtcgacgccgtctgcggaaagggccccatcaccgtcgaccacctcaacaagctcccctacatcaacggcgtcctccgcgagactctccggctcacctccacaatcggcatctttgccgtgacacccatcgaggacaccgtagtgggaaataagtactttgtcaagaaggaccagcccatgctcaccctggtgtccaagctgcaccaggacgcgagcgtgtacggcgacgacgccatggagttccaccccgagcgcatgatggatgagaacttcaaccggctgaacaaggagttccccaactgctggaagccctttggcaacggcaagcgctcgtgcatcggccgcccgttcgcctggcaggaggccctgctgatcatggcgatgctgctgcagaacttcaacttcgtcatgaagccagggtacaccctttcccacaagcagaccctgaccgtcaagccgaacggcttcacgatgcgtcccatccttcgcgacggcctcacgcccaccactttggagcgacgtctcgctggatcgctccctgagacgaacgaccccaaggccgaggccaatctcaccgctgaagacacaagcaagggcgttcctctgactgtgctgtatggttccaacagcggtacgtgcaagtcactggcgcagcaggtagtcgtagacggcgccgcacacgggttccgcacagtcaagatggactgtctcgacagtgtcaaggggtcactccccaccgaccacccggtcgttatcgtcacagcatcgttcgaaggagagccccccgacaacgcgggccactttgtctcctggatccagtccctcaaggacgaggagcaggctctcaagggtgtttcctacgccgtctttgggtgtggtcacagcgactgggtcagcacctaccagcgcatccccaagctcgtcaacagcaggctggcggccctgggtgccaaacaacttactcccctcggcgcgactgatgtgtcgactggtgcgacatttacggatttcgagggttgggaggacgggcttctgtggccggctctcaagaagcaatttggcggctctgacgcttccacggaggagaacaggactggaggtgtcaaggttgtcgtgtcgaacccgcgaaacgagacgcttcgacaggacgtgcagcctgccgtggtggtagagaccaagactctcaccaagtatgctgatgagaagttggccaagaagcatgtcgagatcaagctaccgaccggtatgaaatacagggctggagactacctcgctgtattgcccgtcaacccgaaggagactgtccagcgtgcgatgagagtgctgggtctctcgtgggatgcgcacctggagatcacatcagatgtccccgtggcactacccgtcaatacacgtgtctctgcgagtgatgtcctcagcttgtatgtcgagctttctcagcccgcaaccaagagggtaagcacttattatccccctttcccttccatatattgtgattgaaacatgagattaacgatgagatccaccagaacctccgcgagatcattgaattcgcaccagacgagaagaccatcgtatccctgggccacctagcaaatgatggctacgcaaccgagatcaccgccaaaaaggcctctgttctcgacatcctagagcaattcccctgcctcaacatcccagtcggcgacttcctctccatgctccctccgctccgagtccgccaatagtaagtccaacccccccctccccccccttccttcatatccagtctcctaacattctgatagttcaatctcctcctcccccctctctaacccaggccacgccacaatctccttcgccgtcctccacgagccctccctcgccggcacgggcacccacatcggcgtagcgacctcctacctctccaccctccagcccggcgacaccctccacgtcgccgtccgccagtcccaccaggccttccacctcccctccgacccggagaggacccccttactctgcatggccgctggcgccggaatcgcccccttccgcggcttcatccaggagcgcgccaacatgatcgccgcggggaagcgccgcctcgcccccgcgatcctcttcttcgggtgccgctccccggagcaggacgacctgtaccgcgaggagctggacgagtggcagcgcctgggcgccgtggacgtgcggagggcgtacagtcgtcagacggatgcggcggagagcaaagggtgcaagtacgtgcaggacagggcgtggcacgacagggaggagctgatggcgctgtggaagcaaggggccaaggtgtacgtctgcgggtccaaggcggtcggcgagtcggtcaagggggtgatgattcggatgcgcaaggagatgttgcccgagggggagcaggacgaggagaagctgcaggagtggttcaactcgctgaggaatgtgcggtatgtggtggatgtgtttgactgagctggggtggctttacgagtatagatgtatgattttgggtgggagttattgggaaagattgcctgcattcacttgggggttttggctatcatgggaacagattcctctcttgtttaggtatcagtatatatagttcggcaatttaagtcgttcaacggtaaatgcatctgtgcttttgtgtgtatcaagaaaggctctctatgcctctaatctatcgagggaaaattcaaactggtctagactccaagcccatgtgtcgcaatttgtgtttccatcttgctctaactatcttgtgaaacgtcccttctctcgcacatcctattactagagaagccattcgctaccattatcgagctacgactaatgattcaacttagacggcagtgaggccgttgtcgttcttcatgacgtcctcctcctcgacagaggcagggggaacctcgatgccaaacttggcgtagggaaagtcctcaagcgccgggaggtactcggcccagccgtcgtccagctcgccgacctggtgcatgtcgatctcgccagcctcgcccatgcggccggcgaggatctccccctcgcgaccggcgtataccttcttcagctcggggtgggggcaccagatgacgcgcatccccgcgcggcgaccggcctcgacgccggggacggagtcctcgaagacgaggcactcctccggcttgatgggttcctctccggcggggagggagtcgttgatggtcttgagggcgaggaggaagatgtccgggaggggttttccccgaccggcttggaggcgggtgtcgtcgccgaggacgcggcggtgggtggggaagacggagaagaggtcggtcaggtggttggtcttgacgcggaagttggcctcgtgcgagctggtggcgagggcgatgtggacgcgcttggtcgggtcctcaccctccttgaggttgtagtatcgggtgcggccgaggctggcgagcaggtcggcgacgccggggaggggccgcgtgttggggaactcttgcgcctggaggatggtgttctgcctggtgtactcgtcctggtcgatgggcaggtcggcccagtcgaagaagatcttggtggcggccggaccggggcggccttggaggcgggccttgatgggccacggcaggttggactttccgtagcgctcgaggatgatgttggtgcacttggtatagatgtcttcggtgtcgaggagcaggccgtccatgtcaaagagacaggcgcgaatgcgagggaagctgccgccagagaaacgaaacagttagtgccatgttcgtgatttgcacatttcaatcgcggggtagagtgggatggaggggtaacgatgaggggcacttactctgtacggggagccatgttcgcggaattgaaggttgatagagattagaagaattagggaggaaatcctcttggtggtttggaggatgtgaggttgggagggagaagttggatggctccggaggagagagttgagagaacgcgaagctctctgcagttctgcaggccgattgactcagagacgagcaagtgcggggccaaacgcagtcacggacattttttcacgataagcctgaagcgtagacagagagatcagttattcgattgacactacctctatagaaaagaatttctggtttggtgaattgcttccaggttgcagcttgtcaagctaaacgcgagagtcaattggtttcacaaaaaaaacattgcggccaacacggtggtcagatgcgatgcagcgtgtcctgggaagagtaagtaagcatcgcccacgggtgacggggggttatgcagcaccggccaaactcgcactctgggaacccaaaacttggaattttgcgaggtttgatgcatatcaaaaccaaaccggaagaaacagccccccgccatgaagcggtctggaaggccaatgactgccctggtgggaaggaggaggccattcgcaaatcaatcgccagaatctgaagcatagccgccagcacagccgcccagccctaaatagacacagccccaacggcggccttcctgaccaccagatatttcctgtgtggggggatatcagaggccatcgcagcgactaagctcatgtccccagagcaggaccctgggcctcccagcaaggaggtcagatgacggaatcgagggacattgagccgcaccatggcaagctgggcagctggggttcccttcccaccatccctcgctgtcaggctgaggcttggtccgatcgatcggcttagtcttaccggccagcctgcaagtcatttgtctcgtgccacacgagggaacacggacttgatcagagctacctcatcggggaatattggcatggctgtttgctggtccagccctcgcagcagcctggaggcgagtaagaatgtatgcatgtttccatcataccgtcggtaatggtggtaagatgtggaacaggcagccagcccgtctgtcctcttactggctgttgcctaccaacagctttcgcaatctcagctgttggccgccatttcagacaaacaactagacccggcgtgtgactgctggagaggaaagatatctcgggctaagtcgagtttgatgcagaggttggtccccagagtctggacagagataaacggttggatgtcaaggcaagtttcgtcagctttgaaacatcgacttgaacagagcgcgcttggagacaagaatatcatctcctgggcctcatctgggtctctggaaaacttgagcagtgggtatacaaaatgcccggttttgctccaggcgctgagatggccggtgccagtgggtggtttggcgctgagtccgctgaggaccgctggcaagggcgctgtaattggctgcgctgattgtggccctatccggtcgcacaacgggccgctaaaaggtgggctattaccgggctggtgggcgctgattagtgggcacctaatagtggctgtaagtgcttcctggaggggaacagcgtgcttctgggtcgtgcacgatcccctcgtggctaacaaggccgatcccaaggcgtctacgcatgtcattcctggcccatgccgcagactgcaggagagtgacatgggatgaaagtgggagaggaattggcttcccatgtcacaccgtccgatccccatgccgtcactcgagaagcatataagcggcggtctggttcctgtctcagacgctttcctctcgctctccttcttcatcacactctacatcttcgcacactcacacaaacaaccttcagcaacaggatcctattacccatacctgccacttccaagctagtctcttctacctatctaattcctcttgctgcccaaccggccagttctactgcttaaaacccaaccacaaccacaaccacaaccacaaccacccatcaccaccaccacaatgtgctcctatgaatacgtccagtaccagtgcggctgcaagaagccccgcgagttcagccagtgctctcgcctctacaagagaaacgagaagacccgctgcgacgagcccaagatctacgtcgtcgactcccggaaccggtgccccaagcacctcatgtccgagtcctccttcctggagaagttctacaacctcgccgtcatcccccgcaagaagcagcgcaggatccagttcgtcgaggatcccgcgctcgtcaagttcgtcgagcgcgatatcgtccgcgagcatcaccaccgccactgctactaggtctcccacactcttgggcgtcttgagctttgatagcgaaaccacgcatcctgtcttacgagctatgtcttgaaaatcctgtctgtgatttcattttattttattttttgcctgtaaaatctagttttgttgcctgcgcggagttttggagcggtcgattttgtgtttggagatcggattggctttgtgcgagcgattcttgggtttctgtcacttcaagagaatggagggatcaattgaaattccttctagatagaaattagatagacacctaggtagcctcatcaacaccattgtcgatgctcctcttagctcctgcaattgctcttgcctcttaaacaatgctcccgcccatcctcagccacttgctgcctgcctcagccacaagccatctttacccctcattcttgatccatcgtgtgcctcgattttctttccatcttctctgggacttactcaatggtctcgaatcattccagctacgaccgtggctctctggtagtatcgtatcccgtttgtcaaattcggaacgaccacagcagagtttgtgcgatggtagttgaaagtgcaatctactaacctaccttggaggatgatctgtcagttctcatgagctaatgctaccacactctacccctctatgtaaggctgcccaaagcatggacctgggcttacatcaatcccctgatccctggaccctggaaccttgacctctctgttcacaaaggtagggccgctgcgcccctcggacaaccccgtcccactgccccacgctgacacctcctcccaggtcactcttcgagatctttgattctccatccaattctgaccttcattattcactacagaccgagaagctgcctcaagatgtctctccaagatttcccagacgaattgctggtcctcatcatcccgttcgtggacccaatcgccctcatctcactgagccaaaccaaccgccacttgagacacctgatccagccaaccaaaaggcactttatagaaaggcttctcgtcctagagtgcctcgaagcccacggcggcccttatctggatgtcaggcagcggaatttcagcctccacccgtccactagcgatgagttgaaagacatgcgctgggcctgcgcaggctgcttgaagcttcgctcccaccgccatttcaacaacaaggccctgtaccggctcagatacaagaaacccacccccaacacaagtagtgctgagtctcttgctctcactagctgggtggctttgatgaggggcgtaaagtctgcgcagaagcacaggttttcagcccagccggacgagagaagtctccggcgatacaggggtctctattcgggttcttacactgatgagaccctcgaagagtggtatcactggctacggcgcaacgggattgagaaggtagaaggctgggcaacgcaggacatggacctagacgatttcaggggcatagcgaggtattggggccgcatgccccgcctcgaggaataccacaagtacttggacgactcgcggaaccatggctttgcgcgtctcaagcggctgtgcaacgagtgcctgttccagaccggccgcctacagaggatcaagaacgggcgggctgggttggccctgaccccggtgcagccgagcaggcgcgtccactactacagtattctggatcgatggctgccgggtttctcggacgcactggaccacaagcggccgctggtgcggatcccgagattgctcgagcgcggcccggtgcccttctcggagccttggacgctctacatggtacgttgtccggggtgcgagcaatggaaagagctgcgagctttcaggctccccgtatgcggggcgcgatattcacccatagggaccggaacaagcatgaataaacacaagcggggctctatgcagttggacggggcccgttgccacgcctgcttcgccaaggagaatgggactgggaagcttggggaggaacttgtacgatgggtaggcgaggtcatcgacgaacagctccgtcgacatcttctcgccctcagttgggggtacaggaggctgaaacaaaataggccgagacctgcaatacgggtgcaggaagtgaagcgaattctgaagggtgttcgtctggaattggacgtggatgcggccgaggttgacgaggtagtcaacggctggataacccggtatcctcaagtcaagaacatgtgggatgaagctcgcccgcgtgacatttcgcggagcttgatcagggaggcgagcctggacgtctgggtcgaaaaattccaggatattgtcgattactggttctggctgaaggctgccagggaagagatccagcagaaaccgggccatctggtggattgggccttgcatggtagggacgacgaggagttggcggttatcaaaccgaaaaggaaacgctcttatttcccattgcctactccaatgtagctgaagagcaaacagtgagtgtgtatactgctaaatagagttggagtatagatgaaagaggagctattccggatattataatttatttaagtttttaaataactatatataagtataatttattatattatatttttttggggggggggggtttttgccgtatgcaaggggtgatatcccaaaatcaggccacacgtgacacaatccacacgattagtttttaaccaagttccggtccgtacccaaccttcaactctattttttttacttttcattacacagccagctaaggcacaggcaacattactatattatataaagtagaaaagtttttattagatcttacttatctctttatatattatatttaaatattattatatttaatataaaagattaaaacttaatgtttaagtaataatatatatatttattataagtagtattactcctaagtgaaatttgagctaggattcattctaagcttcaatgttatgaacctcattattacacacgggtcacatatggaaccccaccttttcaaccaatcaagagtggatcatcaggatctcacaatgatcccaatgatccagggatatagatcattgccaagtattaatgatcccttggtatatatacacattcatttctagatagaatactagctcggcagctatcaatataaacatcagtttatgcataccactgcaattctaacctttctccaattcattacctgacttctgagtgacgaagctgtcgtccctctctccctagaataaccgtcaccgaacagacattgattctcactcttgagctaccctatagccccagagcgtaccgttcgtcacattcaattaccaaagccgagccagtagcagtcggaacttctcctacatacctactcagaagtgatcccgcactagggtcttttatacaaccctccaccatgaatgcataattcatcaccatgaccagtgtccttagcaaggtacacttcttgtgtggctgcctcagccgcaaagctcttccacatattcgggcttcttccctttctttcttcctacctacctacctactagtcagagaaagcaagtctttcgcccgagcaggtactcaggcctcaccggtacaaccctacctcatctcctcaaagcatacagctctatcattctcggcagggccgcagagaagaccgactggtaagatcgctgccttttaaggaactaatccaatcaaattgtcagcaaacaaaaccgaccgcagcaactccgtgtaaggggtcaatcacctattctgttacgaagagaagccccgccttccatcgcagctgaagtgacctaatggatccaataaccttgatcggcttggcagcctcagtcgtccagctcatcgacgcgagcaaaaaggttatcggcttgataaagaccttcaaggatggcgacagggacctctcgtcgctggctcaggacatcttcgcgttcacggaggccctcatcggctttgaccgaatcttgcggagcaaatacaccttgcaccggatctctggtccaaccattgagaatttgctgaaccatgcccaagagctcgtacaggagctcgagactcgcctcatccagataggaagctcgaatttatcggctgtacgacgagcgaagtgggtgcaacacaagtcctctgtcactaagctccacgagaagatcaaggagaagaacgtcatgttgcatacgtttatctccatttcgcacgcgtaagacattgccattcacagggcgcttctcttcatcacggaacccaagctaatggccgagcagcgagacgttcttatcccttacgagccagtgtcccgaccttatgcttccgcaaccgtctcatgatgtagccgaaccgacgcccaccggcgatggtagggttgcagaacccttgtctaatagcctacaagtacccactaccgccatgcgaccgagaaggagcagcaacagctcttacgttacaagtactagcacttctggcgtgtcgtctatggtggaccggctgtccctctacagctcggcaaacagtattgcgagctccgcgtcctcgatgtcagtggtgcacggcgacactggtctcaatatctcagaaccggagaagcaggaccttgccatgaccgatgttacgcaccaaagcaaaaggcaggcctactttcaagaaatgttcgttacccgccaatcgtgccgttacagttgccactgccagtgccaccaagagccggccgcgaagcccaggcgcactttgctcggcagatccaagagcccgatcccgaagtgtacagagccgagctgcatggccaacaagactgtggaggagaccgccgaagagtactcgcgctctttccgcaaggtcttatcaagtatcatggcggctaagagcgtggaagtcttttgcgacttggagacatttcgcatggttcctgaagggtctgacccgatgcgctttgtcaaacatggcaatctggagaagttgaaagagtgcattgaatctggcgaggcgacaatacgggacactgcgcccgacggctggtcactgctccatgtaagccgcccttttgcataagagggatgtgacaattgattgctgaccgatcctgtccactgcaggctgccgcgtatcataagcaggttgaaatcgcgaagtacctactcgatataggagtctcatcacacagtggggaaattggagataggttcgtcttggagctcccatgtttgtgcgtttgtttattgacggaatcttcaccagaacacccgccgacttcgccgtgtggaagtccctaggcaagggtgctaccgataacgagaagaagctcgtagagctcttcggtgagaaggacaatgtcctgctggattttgaattcactcccatccacatggccgtactgaacctgtacagccacgaggaccgcgagaggccctcactggaagagtatggtcgcaagtcacaaacaacccaaatgcggccggtcctctaactgattgtaggcttatccagctaaccgatgaggccaacaacgcccctgtcgccaccaactgggcaaagtggaagctcaagtaccgcggtcgttcccctctattaagttctacgcttgagtacttccgagcttcggctttcgagcagacaaagggaacgaaaatcatccacaacctaatcgaccagaaggacaagaaatatcattggacgccactacactgggctgcattctcagggcgcgtcaaggagatgggcattcttatggcccacggcgctgacccaatcctgctgtccaatctcggaggcaacatcatccacgccgccgtcgaatcccagtttgacagtggcctcgtcgccgcgctcaagatctggaagcggtgctccgatcagatgagcatcaatcaagtcaacatctggggcgagacagcggtccacgttgcttcgtgtctgtcggcctcgtgcgtcaggcttctactagacgccggggccgacccggccgtgcaagaggagaatggacaggttgcactccactttgcagggctgtcggcgcaaagcacagagagacttcaagttgccttgacattgtgtaataccgaggacaaggcacatatcaatactaaggactacgtcggccgaacgccagtctttgagttcctggacgaccctgcatgcgttgaggtccttctccaacatggggcgaaactggagattaccgacgatgtcggacgaactgtgttccatcacgcctgcatcgaagggcaggatgcttcgctgcaggccatgctccttcattctcccgatgtagcaggagttcgagacaatcatggcaatacccctttgattgaggcactttccaactcacaaataaagtgtgccatggcgctcttgcagctcgaggatgaagggtcgcaagaagggaagtacaacgtggggcctattgtcggaaaggacggttgggcaccgattcactatgcggccaagctgggtgacgaggacctcctcaaggcggtgtgtcaacatcctagttttaagaaggggttcaagacgctggattgcaagagagccagcaccgtggcgatggaggcggggacatgggatggggcgattaaggagttgatccgagagtatgattacatggatttgggagcttgatcgatattggattactctggggtgaaggattgtatctacactgtacaggataggcggacggcctatgtaatcttttcttggctgagctaggtctgcattgtacaataccaacctgtgtttgccttgagagatacgccctgtttacatagcatacggacgagatgtctttggattataaagcacgtcatgacattccacaaaccagattggattcaacaggagtgaagcgttagccctccggagaactgctctaacaccatgagtaatgctcattattgacccaagttggagcctcgtcaacggtatccccatcatcgctaatccacagcgcgctcgcaattgccttctcttgccgctcaacccaggtggtatcgaagccgctctgcccaatgatgctctgcaccaaaggggacggctcccataaaatcactttgtcaaggcgccactccgctgcttccgcctgggcagcctgaagaaccgcctgaagcgctgctgcctgctccgcgaacccatctttcggtggtggtggctgaccatcgtgaggtttattagcggtctcatcaccctccatcacgaggcggaggacataaagaacatttccaccttcctcgtcttctccatggggacggcctgggagatggtagtagcgacgtgcccagattgcccatacctgcttgccagggctcccggcaatcgcaccttttgcctggggttgtttgccaaataggtgattggtaacaaagtcttccttcctgatatgccatagcatgtggtctaggtttggaaggatcaccacgcgcttctgcgccacgctaggcgtcgacattgccttgcgaatcatggcctcatccttgagacaaagtgctccaagtttcgtctccgggactggctgcgccatggctggcttctccatcttagcaggtgggaggacgaagtgcccattcctaggatttggtagccaacctgaccgggcgtagtacttttttccgatatccgagtacaggacgctcccgaagctcttgccatgctcagattgccatccatggagcttcttgctgagctcattcatatgacgggtcccatagccgcgaccccggagctccaaaggacagaagacactagcgacgccatgaactagaccctcctggacgttgccctcacagtcgctcgtgagggaatgcttccggaagctctcactagaacagaggatctggcgctggccaggtagcagattcttgtcgaccagaacccacgtggtcatgccactatccttggcaagcgggactgtcgtgagatactgagcctcagcgacataaagcggtacagtgagcgagtccttccatgaggaggcggtgttggaccagatctgaatacattcttcggacgtgggctgggtaaggtgcaggtcagggcaactagagcttgggagttcacccgtagagaccatggttgtttactatggcaactctacctagagtgcagaaatgcaaagacttggtgaacctagtggtgatagtttcaagaagcagaagggtcctgggtgaaccacctcttcactggggtaatctcagaatacctaggtaaggtacagggatgtacctaaaatggctcccctgtcccggagggctcttgtgtgtccggctgcacacccgacagtggggacaccctaggtcgggtagtgacagtcagtttgcgttactgtgcctaagctctgatataactttctcttcttctttaactaccgtatctataaagttaatttctagttaaattatattgttttaatattaaaatattgattttttttataaagtataaagaaaaaaatatcaaagtaattaactataaatatatctatatattttattcatattagtttttactataaaagaatatcctaagactagataatatataatttagtttaattatatactttttcctctcaggtataaataataaatgttgaatttgagagattatagccactataagttagtggggtcagatcgctgttagcgatcctgaccactagcnnnnnnnnnnnnnnnnnnnnnnnnnnnnnnnnnnnnnnnnnnnnnnnnnnnnnnnnnnnnaccactagcctctagcgattgcagccactggccacaatcgctaataaccccctgccaacgctagccaataacgattgagatcgctatccgatagcgattaggatcactaaccaatagcggctgcagccactgtgggtcaggcgagcatcacggatgctcacgccaggaaaggtacgtctgctcaacatcaagagtgaaggggcaacggattacttaatggtgttggtagcgtcgcgttgcctgtgttaacgcgtcgtgactcggctataagagtcgctcctccagcgaccgtagattcatgtaggtactacttgaatccacggggccccgattttatagagcctgatggtctatttgaagaagggtggagggtcgataatcaatgctcataatcggtttgttgtgatgcgaccaaagggaaaatacaaatgaaataacaccaggcacagggaatccaggaactccgcagcgcggccctttcttagaagatgaatattctataatgacttgagtataatccaaacatgagctaagataacctggagtttatacctggagtcatagtaacatgacagtattaataataaatacaaattcattagttattatattcttaataatttctcttacaacaaataatcagaaaagggaagatgtaatatgggatatattataactaatgataataacaatcagcgctagtatggtcagaatagtcggactcccaatgcctcacgataaattaatcaacaaataaaatatatactcagcggcaggttttgggcggctctgggtcggtgggcttaacgtattgccttacgatattggtttagaatagcttttaaacatcctacatcatgcagctctgtctatccgccatcatgatgaggctatctgctcatgatcatattcgaccctgtacttggccatcagaatgcctgatccatccagcttctccaaactctgcagcttcaggttgtaccacccgcttaggccactatccaccactttgaacccatccctcagcaagaccggcatcacggccacatccagtccgtccagcagcttggcctccagacactcggcagcaagccaacccccgcccatgagccatatccccttccccccctttgcctttaatcgtcgtatgtattcaatgtaaccctctcgcaatatcgcgatatgagggtgttcttcttgcctgaggatgcggctgatgacaatgatggagcccgggggcttgttcaagcatgggttaggctcaagggcgcgcatgatgtcccatgtcctgcggcccatgacgtagtagtcgaagcttgcgtgcagtgcatcaaaatcaatggactcatctggcacgatccaagaggtagattcatctgggggtgcgatgaaaccgtcgagggattacgcaacattgtacctcaaatgcatcatgaactgtgctgctagggcctggacaagaaaaagtgaaggaggaaactggggaaatgacggatctaatcaaaaactataggaaacagctcatctgcttacagaatggcccatatttgttacgagaaaatcttggatgctaggaatgtgtggaaggaggggttgaaccgtgaatccatatataaataacccccaaaatattcacgctcattagttctctcggaatccccaatagccaggcctacttatccttatcgtcctccacatttttcgcatcgcgcttcctgctattggtcaaacatactatacacattactgctgtcggcaaaatgattaagatgcagtagcaatcgacaatagaacaaagatactacatttagatcaagaccatcttgccagtcgatcttccgttcttccctgtagcgacgataataacctacatcgtgatttcaaagattttataaaagacttaacagcaggcaaaagactgccaatatatatacggaattaccacaacactcctcaagctaattcctcattttaaatagtctttaaaatcttacttaaaatattcctcttgaattttactaaagcccacttgggggctatcatacagccatggtagagtatttctcctagcaaagagagtaaatataacaccattaaagccaacaagtaaaacactcagtgagaaatccttcacctaggttactatattattactagtagaataagtaaggctatactgcataggctttacatagatatatagtttaaagtcgcctgcgattttctttatattaatagaaaactctattatccgacttatccccaagttagtattattattttttaaggttagttaaagagggtatacctctggcagagtgcctggaccaggtaactttactgttaaattgatatacacttaccttgtctccgatctgctccccccagcaaccaatgtagcatccttcttgccactctcaaaggcactggataaagaccagttaaactagctagataccaagagcagggctgccgtcagatcagattaactatcagatatatcaattaattcaatcaattcagatcaaatacggtattctaacagatcaatcaattcagacacaagcatctatacatctgatatatctgatatctgtaaaagatagtgactaccctagaatcgacggatcttccttatgttccggccccgaaatatccctaacataaatgttccggtcccgtagagtggggcacttccccaagaagcaatggtgctagaggaccgagacaagccgattggctggttttgaaccccaggccgtcggctagagagcaatctaaaggtagattaattggttaagttaccccttgttcctacctcttgccccagtacgacacagccttagccagagaccgctttaaaaggcagccttgctagtagcccttcgtcatcaccgccaccacccacattttctcgtctcgggtcccggtctgaggtcatcgctaagcagtataatgtagtattagctttggcctcgactgccgattcgtccgttgatgacctttgtaagatcatttggggccaacgccgttttgttattgcaagcctcttagacaagaggaaaagtaggggcaggcgaagctggattggaaactatggctggttcctagcagagttgaggaaagataatacgtccagtggggatatctggtgttaccagctctgcgatgataagggtgcaccgcgattttttaatactcagtcaacatcatcggtatcagctcatctcttcaagttcgtggtacttctcatttccgggctatcactaacggttcttagagctcacgggatcaccgagacctttgaagcgggttcatctggtgactcttcagttatcgatctccagagaaatacatccaagaaacggcccgcctcttcttccttccttcttcctcgagcaaagatggcacggattagagagctctctgttggttatatcgttgattctaatctcctctttactacctttgagagtacctatctgcaggacctgttacagtcgtcgaatcttgattttttttcatcgctgccctaagcaggaagaactcaggcgctagttcaatacatctcaggtacactcaggtttactcaggacttaaattttcaagcacctgagtttcaggggtggttctatctgtttgatatatttacgagtacttctttcaccctaccacctattccagccaagtataaaagttatctctacctctctttgatcgtgctcattcgttccaagcttattcttaaaatacccttctatccagctacagcaataaagagtaaagtatcttctaatttaaagctataccgagaagcattacagcttggtaaagttcttcagccttcacaagtcgatccgtatccggtccgccgtaagttgcagtatatatcaaaagaacgatataaaagagagtataagtattaggaagagtaagaataatgattctaggagataatactctgtatactaaatatactaggtttcagagtgaataccctgaggtaacacctcttagcctccaatatttaaaggcgtttggagaatatctgattcttattacggttggtaggctacacagggataaaaagacaggagagaggacgggaaaaccctacacaagcgctatacgggtaaagctgcgaaggttcacagagcagtaggagcgcaaatatcacatatctatccctgaagtggttaaagggtctatgtgttcggtatgtggatttatttctctaagtaatactgctacttaccattagctctagtatattgaaggggaaatagctgagaagtatgatcttcctcgaggcaaacaagcagaaaaaccaaaaaagttcctcacaatagagaactatacaactatgcagatatttcactggacaggtgactcctataactgtatatacgaaggaatgaggattgataatacgaatctccttaacatacagccgttcatatctgctaggaggcaagaagttattatagctgtatacagggtaatattttcttcaaggaagagaaatctgcgctagctaactctgttttaggatctagaatagtatattgcggagaccaacggggagccagaatttcgagttaaatttaccaggaacttttgcaaaggaaaagacaaaaaccagtatataccttaagtatctatattaatatttgcttaccatccgcaggcctgagcatccattgcctgagagactctaatcgtctgatggtaaactaccaccgcttttcgtacaaccagtattctacctccttggaaattgtatctcggctggagtattcgctgattataggactgttgataaggtacttgccgtcaggcggccagataatcaattatatgggatccttgaattggatcggaatattaaaacgaggccagtgttccctatatggacatcaagtggcttatcccctaagtctagatccccgtatagttagggcgctttaatgtccgactggggtatccgggcaggcttccctgctggccttcaaccccatgatacacgccgagagattcttattaaagctgctggtataatatatacattctactgagagtctccacctaataaaatatagacgaaggttatttattagtacaagtgctcaaattcgcctcctaaaatagtataggtgtgcttcagtatcattatttgagcaatatatctagcgtggatagtttaagcgcctttttaggaatacagccacgaactgacctggctgaaagtttttgatctgcaactgtacaatagaatccccagcttttacagtctctatcagaagaatagaaataatcagtgcgcgaagaaaaagattatatcaccctcagctaaaaaatcgatatccttggtatgtaaattagctctctggcctgctataataaggataaggtcacttatcttataatagagaatctccaattagagcatatctcactttacaaagagtatgagcgaatgttcacaactaagctgaaaaagctacaaactacccagaagatctcctacagtaataagggtaattattcgggggaagatatctaataggaatttctaaaacgtatccgccatatgtttctaccagaacgtattcgacttgccgcagtgatatacgaaaggatacaacctcggagctctgagtggattaatactctcaaggatctagttatacttcgaaattccgattgttctgttacttaccagcctgaactcagaccaaaggggggctactgtccctattgtaaaacagaaataaaaaggtaagtattgagaacagaaaataatataacttattattctaattttgagatagtatagatacaaaaaagcgctggaagtatgtgttttcctgcgcatctatacattacgggcgaaagaataactattcccaattttacttttattgcaataagtagatagctagcaaaatatattgggagaatcatctataagcccatttggactcgcttgatattccgactcgatgtaaccccgttatctttcgctataccatagcttgcgctggctattaccctgttcatttgggcaatactaatcttatacctactgaacaaataaagcagtttctgtaggtaggcctataggaaaagcatatttcagagtatatccctacatatatctaaaaactccagggctagataccttgcccacaccctatatattgctactatttcaatgaccgataaatatttctcaatcatttagcagatgttcacagcgtacagctggaaatcaacaaactggatagcaggagcaccatgaaaccaagagttaacccaccgctcaaagtcatattttcaaaaaatccagaccagaagaacaaagagcttgataattcatcccgtccaaccaaaaagcgacatcaatcttcggagtccttcctcgctctctatgccgctaattctggctctcactcgccgaatattaagagccgacttgaatcgccctacatcttacccatcgggcaatgtaaccctactgagcataatcttcaattgaaaatcgcaatatccttaccagaaaagatatgaaaagatttagcaataagccgctcagccattaatagagagaaatttattaatcctagactataggaagatacagtatctttacatataaaggaccgtggaataaagccagaagttgaaggcttatagcacaggcaatcagatacttccgaaatatattcacttaagagcagttatccacctctatcgcccaccgtggagccggaaaggggattagaacgaattgcatatcaggctaccttgattactacttccaataccgtccccggcagtatgattaacttggaagcttcaaatagcggggagaaaaatagctacttcgttcaacatccgagagaggctctacttccgaccctggatttagaaaatactaccaattcatctggcgaccaatataacctcgataacacctattaagtccaggaattagttaaaatgtacaaagaccgtaatcataccctgttcctggtaaggtgggccaatagaggtacaacctgggagccagaggagaacatcaataatccacagcttattgatgatattatgaagaactactaaggttttaaaaatagggttgaagtggagaaaacacgagcggccaaaaatggaaaactggaatactatgtgcgatttaaggattatattggcagtaagagggatttatactggtgggtttctgagaatataatccatccagataatcgcaagccgggggtaaggtaaaatcagaggaagagaaaaagggtatagtaaaaagatatttagcttatagttacttagctgtatcttttaattttatatatatactggattttcatattatgtaaatactaggtaaaaaactacttctcttactgaataagacaatggccaaagtttaataccacagtttaatataaatttatctgaacagttatttaaggcctctagcataataaataggtactaatctgtagcaaacccctccagccttattacttaatactcctatatctaccctacttatggaatatgccctctattcggcaaggcaatattgactatcgttgcgagagagataaatacagggagctgctggcgaattatatttgcaagtaatttagaacgagttatcgttcgattgctaactaatttgcagtatatgaattgggcgtcttaattccgccctctcaggttagattaagcctggccttgaaagacccttatagataggttattcgtgataatcagaaaaagctcttcgaaccgattttcattaaaaatctaagttcatactctattaacacgtatcgctttctatcaaatggggtcaagagagaagcctttcgcgcggtacccatagatgcaaactctaataataatatccgttatcctatatcaaaagctggtatctattaacctagactagttgtctgagtcagaagactgctcaagttctataattgatcagatccagagtgaaaataatagcctccttatacagttgaatcagatatcaaccttactggatacagagtcaagatcacagcagctcgtagaggaaaccaacgaaaggcttcttatacaacagcaggttcttgaacaacagctacaatactatatcaatagagaaactgaactccaaaaggttcttcttaacttcgtcaaagtcctccaaaatagcggagagaattctattttccaacctaatagttaagggctttaattatatatagaggtgtatggagtatatatgcgagcacgcagggtagatctacttaatatgaaccagcctgttttagccatttttctgctagataaaaaagggttatagttctgcttggtcgaaaagtcttactaggacgctgtatattacagtattcatattacatagaagcctattaggaaaagtccacacactgctgcgagtattatataactctaaattagaggaatgttcttagtaataaatttagtaatgtcagaataaaataatagataatatagcaaattcgcggtaagcctattttgtaatcaagacagtatttcggtaatctagactgaataaagataagatatttagtttttggcctgtaatatcttactcggatattattctcagtacctttcgatatacagagaatcatgaacatgtatttaaatactatgtttcccactattaaattccagggatatatatttgaatatactaaagtctttaatccttataaccagatgctaaccttatgctaccccagcccatcctcgacagcgatatattagctgttgataagtatcagccagagcggtactaccaggctttatcctattatgatgtccaaggagataaagaagtaatagcaatcaacccggattctgaatcagatgtttccatgtcaatttcctccggagatgatacatctgatgataatgaaccagaggaagctggacctatcgaccatggaaggtatccagcgtttaactctggtaggttggaactctttcactccttactgttactaacgacatgtgtattaaaagacgacctgttcagaatatcgtgtcctttctccaaaattgcccctgattctgtcgatcttcagcgttcacagcaaatggctcataggctaatagaggggaaactcctgcgagaagaatactcggttatagtacctaagagcgatcgaagcacaggggtacatccaagtcttgcgagcaagcagctgccagtggacgaccaaatctaccaggtgcacgagttctatcactatgggggagcccaactgcctaaagaagccgccgatacaggcaccccatgcgaactggacacaaggtacaactatcaaactgtcaactcgcgagatagatctatagtggccgagagaccctacaatatacataccatacgctatactatagtggaaaataaggtgccccctatcttaactaagagcaaagttgaaggcggtatcgccacagcgcaagatggtattattacgcttacgcaactaaaataacgtatattggaattagagcgagggccagagaatgagctatagataccgccttgcactagcaaaactggttgctctaaagtgccaactaatggaaccagagatatatatgtagattctggacctaccaaaatcaggcgcagcgaaagaattgctgaatctatattgcggagatatgagaaaaatattcgagtggagaaaacttataatcgcaaaccaaggagagggagggttctctaaaaggatatagctgacaggtggccagcgatgaagattattacgactactgttgataataaaactcagaaagaaatatgcctaatactataggagcccagttagacgataaaagataatatctcccaagggctcgttgaagcatttcaaaaaaggccgaaggagagactaatttctcgtttgtcaccagaaacccagcaccatttccgggcgttctataacgctctccaaagctccgaaaacaacaaacaagagatttcacagttattagcttatttgcaggatatttttgattgctagttttgggcaaacatttagaaactttcgagttaccttaatactgaaacttaaattggttgcatgatatcttttataacttgtagaggtgatagagataaaggaaataaattctcaaactaaaccccgataccttgccctgaaaagcaaggagtccttatcaaaaaagcctaattgattgctaggattgattacttgattcaatccacccttttatttgaaagtaaaagctcctcagcagtccatatgactgaattagacccaagataacccatatctttactggcaacgccccaatccacacccataggcccaaatgagtgtatactgtcataggcttcaccaaagaattgtccctcccaacaacctttgtctggtaactcggttatcgtcgccatcttataatattgaggtgatttgtctaggacattcggatgaaactgttgtcggaggagggtgatttcgtcttgtaacgattgaatagagatacgaaggttgtgttgagtctcttctagtttagttacacgcgatgtgatgttgtccacctgtggatctttatgaggccggcgtttccgcgactcgcatgcggtagatgtcgtaacgtgctgtgtcctgggtatcgtcatattgtattaggttggcggctattccacttgttattggaggtgcttgaagccgcttgctctacagccagatatactatgtgttatatatatgtgcgtaatatagtactgtactatacagtttggagtataaccagcttccgctctgttgtctttatatttattttcgagaagagggagtacctgaagatacattagtatacatttcccactattttacagcatgggaaatgtccattaatggccagcaaataagtttctcaaagtagactaagtactaaggtgggaacaattgtgcgcacagtattggcgcgaactctcgataccttggtgagcgataaggtacatccagcctcaggttgctaggctaactacttaattacataatctccagagcagctatatcatacgggaagacggattatagataaacccgaaaaacctcttagtcattcttaagtttcgcgaaccaagtgcgttacgactaattatttgtcttatcgtttctgcctaatcgtccttcccccgcattaccaccgatatcatctttcgcgacaggacgaagtgtcaagagctggtatagcgtgtggagcaactaaaccaatagcattggtaattttgatctcttcgatatggtccctacacgccctgcttcacggctcggatttgagattgccatcatctgcgccctcactattaaggcggacgctgtcgagtcactcttcgaccagtactgggataaggagcactcctttggcaaggcgcctggtgatcctaacgcttataccaccggttctatcggtcgtcacaatgtcgttctcgcctatatacccggtatggggaaggtaagtgctgccgttgttgcagcacgttgccagaccagctatcccaagatcaaactagctcttgtcgtgggcgtatgcggtgctgtgcccttcgtatcagatgctgacaccgaaattatcctcggcgatatcatcataagcaacggtgttgttcaatatgacttcggatgtcgacttcccgaacgctttattcgcaaaaacacactacaagaatctttaggcaggcctaatttggagattcgcgccctactagggaagctagagggcaggcgtagtaggatgatgttgaataagaagattatcagttatcttggagagctacagaaagtatccaatttgcaagcgtattatcctggtccagactacgataagctgtttaatgcaaattttcgtcacctgatggatggaaagatatgtgaagaatgtggatgcaatggacaacttatatcccgctatcgattagaacaagactatatacagctagcggttcactttggatgtatcgcttccggtgataccgtgatgaaatttggggaagagcgcgaccagattgcaaagcaggcgagtatcatcggctttgaaatggagagtgctggagtctgggatattttcccctctatagtgataaagggcgcctgcgactatgctgatagctacaaaaccaagaagtggcagcggtatgcagccgcaacagcagcagcttgtgcaaaagcattcttggagtattgggagccttcagctatagaccaagttgttgatgtaagtactgcaaaatgtacgtacacaggattgggtgtacaaaggggatacttactaattggactatagttactgtgctgtatcctagcaatccagactttattggacgctcagaaatcctacagcagcttagggagaccctaggccatatacagcagagagctgcatcctcttatttaagagcctcgctctttggcttgggcggcgttgggtatattctttagtcttgtctatgacttttgaaaaaaaccgaggttgataccaagtaggaaaacacagattgcgctggcctatgtatactggctgcaagagacacaccctactctatccgtcttgtgggttcatgctagcaacgccgatcgcttccgtcagtcatatatatcgattgcagaagagtaccagatccccggctatcatgatccaaaagtggatatcttgctattggtgaaagactggctggaaaggaaggactctggcctatggcttatggttcttgataatgcagatgatatgtagctcttctttggttcgctagtagctgcttcaagcttagctggggtaagccaagcggggccaggccgcttctcagattatgtacctgagtgccgccatgggtctctcctggtcacgacaaggaataagcagctaggtgttcgactggctaagggccgacagccagttgaggtgagctgtatgaatgaagatgaatcagagcaattacttcttgctacacttagtaatatcagggcgacgactacagagttatcattattattgtctcaattggaacatctgccgttagctttagttcaggccgctgctttcatccaagagacgtgtataatagtagcaaaatacctccaactacttagcgagagcgataagaatatagtacgcctattaagcaaggagttcgagactgtcggccgagactctttaaacccccaagccgtggcccaaacatggattctctcgttccagcagattaagcggtagcactttctggcaagtgagcttctctcgtttataagcctcctagatcgccaagacattccagcgcaatttctatcgtattatattgaacagaaaggaaatgaggaacctataagcgagttggagcttacagaagcattaggggttttaaaggccttttctttcgtgactgaagataacaacggaagttatgatatgcatcgtctgatccagctagtaacacataagtggattaccagtagtggcacatacgattgattcgggaaggaagtattaatggtggtctcaaatctttacccttatagcacatatgaaactcggacaacatatgcgatatacttatcgcacgcgaatgctgtactacgatcatatgatttcagttcaggagatgaggccgaggcaaaggcttctcttgtttattgtatggctgtatacctcaggtttgaaggagagtgggatgatacagagccgctcgatatggagggaatgcgtattaggagagggctatttggccaggaccattcctctacactgacgagtatggccaatcttgcatcaacatattggaatcaaggccggtaggaggaggcagagaagcttgaggtgcaggtgatggagattcttcagacgaagcttggagcagaccatcctgatacactgacgagtatggccaatcttgcattaatatataggaatcaaggccggtgggaggaggcagagaagcttgggttgcaggtgatggagacgagtaagatgaagcttggagtagaccatccctctatactgacgagtatggctgatcttgcatcaacatattggaatcaaggccggtgggaggaggcagagaagcttgagttgcaggtgatggagacgagtaagatgaagcttggagcagaccatccctccacactgacaagtatgaacaacttggctcatacttggaactctatagataagaaaactgaagctatggacttgatacaaacttgcgttcgcctcacagagatgaaactaggagtggatcatccacatacgcgatcatcacttttagctctagatagttagcaaaagtaaatattgtacagtgcagcatcatgataatatggcccgaaatgcacagctctagactaaatcaacagtccgattctcaagatcatatgtatatataaaatagtgccctgaagggtcttaactaaaccttgggtaactttagctgcggttctggagtgggctataacataggggtgcccatttgtaggccaagtccaagaaatagaacaaagaactgctttagctctaagtcttaattcatgtagattttgtataaagtgcatttttgtggcaaatagcactgtgtggagtatcagttgacattcagagtatgtttaaaaagaggaagctggttatgctccaaactgtacttacgccttgttaccctccctcacagttggaacttagtccaacaaggttggtcaattctggcttgtccccataacagccagcttcggctcctcctgcaagctattgatcctaaagtggtggaaaaccacagaagcagtctcacgtacattttaatagaatggtcaaacgataaagacgatacgacagtagaagtatgggaagcaccaaagtggcggttgttggtgtgccaaattcagcattgcctaaaccactaggtcttctcaaatccaaagctagatttcatctggtatatttgctagggtgtatagtttggagcataaccagcttccggtctgttgtctttatgtttcttatttaggatggggagtacctaaaaatactttagtgtacactcaccacgattctttagtatgggaaaatatctattaatggccaataaataagtttcctaaagtatcttaagtactgagctaaggaaaatgatgcttacagtgttagcgcgaaatctcgataccttagatgaatgataaagtacatcccaatcgttgtgcttatgtgcctgcaggggggccagtttgcctcctgttaagtacaggatgggtcgaaaggagtgtccgcctggttttgtgcagaaagttaactttaatcacggaccactccatccacacgtggcttgtaccgtgtttcacatccctttaggcatatagagtgtgttctacacatatacttaccaacgtagaatcatttagcctgcgctatcaagagtcagcctccaacttcgaccttatttctgtaagtatatccggatagagtagcctcgtgtttagagagtcagctttaccgccatgcaaggatgtatttatgggtccagagatgcctatccaattagtcattaataaagtcgtgacctcgcattaaaggtgccatgccccaaaacctcccttacttaaagctagcgaaattgcatctttcctgcgtctgaattaaagcttgttgcttctattcgccaattgctaccacaaataatatctatcaggatggctcaggtccaaggctactgcgacgcccgtttttccaagctccgcgacttgatgcaagaatttatcgcgtctggacaagacattggggcgagtctgtgcattaatatcaacggcgacaatatggtggacttataggggggctacgccgacgtatcgaccaagaaaccgtgggaaagggatacagtggtcaacgtcttctcgacctcgaaactagtcaccaacctggcggccctgatactcatctcgcgtggtgtgctgcaccccgatgacaaggtagcccagcactggcctgagtttgcggcgaacgggaagtccgaggtcacggtcagccaagtgttaacccacacagcgggtatctgcgcgtggcaggataacatgatgctggaggacgtatgcgacatcgaggcggcaaccgacaagctggcgaaccaggcaacgctatgggctcccggaaccgcaatgggataccacggtataacgcagggattccttatcggggagctggtgcggaggaagacagggatgtccatcgacaagttcgtaacggaagagatttgccggccgctgggcgacgggacggacttccagctcgggtgtcgcaaggaggactggaaccgagtggcccccgtcgtgcctccaccggggccctcgatccaggaggcgcttaacaaggcggggtttgagcaggactcgatcgtcgtgcgcacgttgtgtaacccttcgctcaaggccgaggatgccaacactgcgctctggcggtcctgcgcgttaggctcggtcaacggccacacaaacgccagggcattagtcaagatcctctcctgcttctcgctcagcggcacatgtgcgggaggcggctatcgcctgctgtcggccgagacggtgaaactggcgcttacggagcatgcgattgggacggatgtggtgacagggcggagcgggaggcgcggactcgggatatacctcaccggacctgggtctgggatcgtcgaaggcaagctaccggagggcagtgttggatggggtagcggatggggcggttcgatcgtggttgtggatagtgataggaggctcacactcgcgtatgccatgaacaggatgctaagtgaagagcatccttccccggcagcgttcattaagccctcgacgagctcgccgtcgggccgtagacccagctcgaggcgccagttgaaggcgtcggtgagggcgtcggcgagggaggccatgacggcgagctgctcgcggtcggcgcagccgtcttcgcgggggtcgcgcagcatctcgggcctccacgatggtcggtcgctccgccgccagaagtactcggcctcgtagcccgtgaggggctcgtcgtaggcgcagacggtctcgtagaggcggtagaaggcgcgctggggggtgtcgcgccagcgccaggcggggatgaggcgggtctcgtagacgtccgggtggtgctggttcatgtaggcctccggttggtaggccatgatgtcgcggggccggggcgggaggcggcaggggaagaagcgcgggacgcggaggaagaggaggagcaggcggaggagggggtggttggagatgcgggagaggaggcggtaggaatagcgcagctcgaggggcgtgtggtagaattccatctgccagcgccactggcgccacttggccgagaggtggttgaggctcatgccgggatgagagagagaccgggagcgagagagagcgagtgaggtgttgcgtcacggcggtgactggctctgggggtgagccatccgaagggatctagataggcgatcaggcgcggagggagtccatcaactttttgagtatatcggatgtaggaggaagcgagtggaacgggtgtcgaagcacgagcggacggaggaaaagacagactgtgtgattcggggtggggggaaggggggccaagagtccgcggtgtaggatgggggaagccgagcagagcagaggccccggaacgagagagggatgatggagacgagggagagagagacagaaagagagaaagagagcaactcaaccacacacagggacgggagatgcggtgtggttggtcggtaggagagagagggagggagagtcggggacgaccggccaaggctcagatggtgtctcgagggcgggaaggtaggctgggcgattaaataagaacgtgacaaggaagcagacgagaatttagtattattagtagtattattagttcttccggggctcctgcgcgatgacgtgcggtggccccagcgagtgctacgcgtggtgatggattctaattaattacccgctcgccgccgtgttggtcgattgattcatcttcttttacgagtcctttaggcttcgattcttttcttttcgagcttcgatcgtccctcgacggcgaccagggcctaggccagggggtggtgggaaaagcaggaggatcaaggtgactgacggctcaagagccagggtgggtgggctgttgacgacttggtgccagacgatcacatcggtgaacggagatatgaaccaattcgtgctggattgggaggaggggcatccatctcgtctcatggcacaggctgacggcctgggcgggcattggggaatgatcggctcttgcgccgacaacgcagccaagcaggcacatatcaggctggatcagacagccagactgatgcccctttcctcgccctgcctcgcctcgagtcagcgattcgtctgctggaacggtggatctgccgattttgacgtcgtgatccggccggggagaccaggactgcctgacattgaacccagccaaccggcccacaagagcaactgatcgtgtctctttagactctcaataacttcctgctagggtttggcgtgttttctctttttcttccgagcttccaacacccccagttcaaggagaaatcagattgacttctctctcatctcccggacttaagcagccccttgtcgtgctatagcctccgcggaggtctctcttggtccatcggtgacgtttacccgctgcatcgagggtcttttggatgcgacgctggaccaacaccatcttctatgcggcggcgatgccaatgcccaaggcgctgctcgttctcgcgcatttgcctgctgtgtgctgtcccaacccaaccacggctaattcccccaatgtctctctgcttctcgtgtcgtagaaatctgagcagccttatattagcgcctctggattctttcatgcgtcgtgcattaataattcgctgattatcgtgctgcatatgtcagcaagagcctccactgagaccgctgaaaccgctgaaacatgcttctcagttggtggctctcaggcttcacggtgattgattgatcgggaaagagctctgcatcgagtacctgctaaactttcctcttgctacgtcaccagtcagaaatcttacccctctcaccagacattgatgtttgtttcttcctcacgagcacctcgaaagaagcagcagaaatggcctccagcatcgccaggaccgtcattgcgaccggatcctcctctggcctggtatctttaaccgccgccccattctacggaatcaacatcccgctaacgccaagtctagggctttgaggtgatcaagcagctcctcgagcagtcccagccgtacaaggtcattgttggtgcccgtaacctcaagcgcactcaagatgcttttgacgcgctcaaatacgatcgcgccgtgcactcgctcagcatcctgccgctcgagctgaacaatcttaagaccgtcaaatcgttcgccaccgaatccctcacccaggtcggctcgagcaagattgactacctcttcctctgtgctggtatcagcgaaggcgcagacaagccagggccacacggctccaagtggtgcgagcctttcatcgtaaaccatctttgtcagtctccgcctcgtttctttccatttgggaattaattcgacctaacttcgagtctcaaacagcccagcattatttggtccacctgctccacgagaagctcgtcgagtccaagtcccgcctcgtcttcgtgtcctcaggcgccgttcgcaatgtccccgacgtctccgtcctcgacaagcagctcctcggagcctcgggcgccccccggtcctctacctacccgcagaccaagttcgttggcctgctcggcgcacactggtggcgccgccagctcaccggccagtgccacgtcgtcgccgtgtctcccggtctgattcccgccaccaaccttgccgctggcctgggcctcagtgtgaacatggcggacgcgaaaactgtgcctgaaggtaatttagttatggccattctctttcgtagctgcgctgactcaacctttcatctaggtgccaagagtcttctcgaagcgttcacgaggaccgatttcccctcagacccggagcagatcttcctcaccagctggggagagtggtggtccaaggatgtgtatgctgggtcactggataaggagttgcaggataagtggtgcccgagcaaggagcagatcgaaaaggaggagaacatttctaactgatgcgtactatgagacgagatctagaaattccagtaaaatgaatagtagagcctgtatggtgcctgagtgataaaggcagcggttccccaagacaatttcaatgaccagagccaccaattaacacaagtgacaattgagttatcagagatctagactattgacctttatttgattcaaaagattgctattccgttgggcggactcgcgacacctccgataacctagaatcatctcaagttagtatagccctccacgagcaactcgatgaacacatcactcacatttaacggcatgctcgtaaagaagaagctccatcttcctctcttcttgcattcggcactcaggctctccaggtcgaacagctcccctagcgggacgccccatccagccagaagccactcgtgcagacagtattcgcggttctgcaccggccacgcctcgacgcttgggtgatcccccacgactgcggaaaactcattctcccacaaccacctcagcgtatcctccgaactctctacgccgatggcgctgggcacagctagctccgttagggccaaccggtctggtgcgggcaacttgttgtaggcgcgcacgtatccgctcctgatgaacaagatgtctccatggcggaaggtagttccttgcgactctgctacctgcttcagggttgagactgttatggaagtaggagcgaagatagcaggcgagaggccttgtgaatccgcccaggcagcgtagtcgaggaggacaccgcggcctactatgcctccactctcaacccatgctaatagacgaggagtcagtgagaggctatccgctattgagatgggggatatgcgggcataccgtgcatgctgttagcattcgaatcccgtatatcatccggcgtcttcccattgtagaacagcccctccttctggaacccatagtgcctgaacccgtcccactgcgagctgctctgcgtgttgatgctaagcgagtcgtcgaagacgatcctcggcgtcttctgccagaccttgtgctccaggggggcacggccgaagcaagggggggtcaagtggccgaggggcaggttgacggagacgcgcccgccgtcgacaatctcacgggccgcggcggtggtgacgtctggggtgaggaggttgagcatgccgagctggtcgtcggggccccagaggccccatgcgttacccctgggcccgtccttgcgcagcgggagctcgtcgaaggtaggtctcttactggtcatggtttctgtaattttggggtgagtttttggaaggtgtgatgggattcaaagcaaccttgaaatcaaaaggtggaaaaacggaaacgtagggtgaagtgacggatttccaacgtggggaaacggaggggcatcgtgcggggaatcgggttaccagacaccgagctataaatcttggatgaattaactaaattaggagttgctaattgaagagttatagttttccagtctctagcaaaatgcctaattactttatttggtttggttgatgattttgttgctctacaagcctcgtttgagagttaaagatcgacgttacaaagtactgactgcactggcatcaatattggagctaacggtggagaatcctttgtgatgaaagcaaaagagcctagtataagaaatgagagtaaacaaggcctggaagtggaggctctgtacgcgatttctttcttcagattgtatcctagaccaactactatactgagtgatgagtgataggcatttaagtgatttgtacggtgagaagggggaaattgtacgatcagtcgaggaccgtcgaagagtagtatattataacacgaaacctaaacttaatatgatagctacttcttagttactctgagaccagggatgatagacatctgctgcgttcgcagttgcagtttcaggtcttctaaaccgcctttgactctacagctggcttgttgtccacgtggtcttcatgggtagcaaccgtcatttcagtctccttttccaatcccacagtcaccaacgccttagcatgctgaaagtcatctgtgccatcgaagatgccagcaatctcctccagcgtgaagccgcgagtctcgacgtaagtgaagtagatgagcaccacgaacgcagagttgaagacgcactggacaatgtagtatctccacccaatgttctcaagtgcgacggggttgagatagctggccacaaaggcggaagcgttgatgctgaacatggtccacgagaagaagacacctctttgcttcgtggttactacttcaagcgggtaggcgatgaccagtgggatccagcaaatcgcggtaaagaagctgaacacgaatatgatgacaatcaatcctataccgtatccatccttggggtcgcgtagatacgtagccgtcagcgccgtccagacgataaacgtcacggtcatgccgatggaggaggtaaggaagacagtccggcgtccgacgcgagggatgacgaaggcggcaccgacagcgcaaacccactgccagatgttgacgaggccattgatcagtgtcttttccttggaactagtcatgccaacttggtcgagaataagtggaaggtaggtggacacgaagttgctgcccaagcactgagagccaatggcagtccaaaagccaagccagagacgatgacggttgcctttggatccgagaacggtcttgatgccctccttgttgaatttgatctgcgtcttgtccgcttccagaccggcaaggatctcttgaagctcagcctcaacgaggggagttctcacgccattgccatgatacttgacgaggatcgcttgcgcctcgtcgatgcgacccctggaacaaagccagcgaggactctcggggcagaaccagatagtcaaggcttggaagcacgggagcatcagctgcagaatgcagggaagcttccacgcccattgcgtctccatgctgaaggtggcaaatgtgacccaagagccgatgattaggccgacaaagatgcaggtattatagatcgaggtgagggtctcgcgctgcttcgggtggacgagctcggtgatgaggacaggcgcggcgatctgctgcaggttgctgccgaagccgagcaccagcttggcacccgagaacatgctgaaagaagtcgcaaacgtctccatcaggaccatgccgatgacgatgaggccgccgacgaagacgagagtcctccggccgaagcgatcattgaggggtccgccaatgatgcaggccacgatgccacccacggtcatggaggcgccgtagaatcccagtgttgcgcccgtggggttgccgaagttgtccatgaagacggagacggcctgcaggccgttggtcatgctgaggtcgaagccccaggcggcggatgtgaccatgggcgacagcaggagcaggtacagccgtatcaggccgggtgatttgtaccatggaggcaagtcttgcatgaagcgccggacatcatcttgatctaatgcagacgacatggcgaagggtagctgttggagttgagaacaatgggaaagggaataggggagatcgtatgcctagagtcgatgttcgagatggtaggacgagattacgaggatatcgaccgggtttggatgccctgatataccgtgatggtatcaagtatacgaagccagtttgcgaccgccgtggaagacactattgtcggcgtatttcgagccgagacaagaatctagaccaatacatgacacgatgaacaacggaagtcactcttcagcagtcccagtattccaattttcacaaatgaagaataccccagattggggaaaggggatgccttgactgtcatgactggggaagctggggtctgatgctctcacgcacccacctccaagcgttgccggatggagtttcgagagagaattttatgcgctatgggctcacactccaatcaagatgacgccgaagtggaactcgggggcctcccccgatgccaagacaacaagggactcggttgcttttgcacgagatgctccgctccgcaatttggagctgggacttgattcctcggacatcatcagactgacagggatgtctctgccattcacatttcaccgagccgtcacacccaagctcatgatgaggcagatgctccgaacaagggaataatcttctcggctaagcgtgggcaccatggcggctgatggcgagtcagagtcagagtctggtgccgggatgccggaaaaccccttgtcatcccgctcaaggtacgcactaccctatgttttctgtgatgttattgcgaacccaagcatgggatctttcacagattcatcgaccagaactaacgctctgctaacgcaatagagcggcaagacacatggtgcgctcaaattcgcagttgccaagggggcattcgacaccaaacgcccatcaaaaccatattccggatattctagctcggctgtctcatgtagagcgcattctgaacctggatatcaatgaatctcagcaccgcggtcaccgaagtagagatgcagttgcagatatagctgcccttcgttcccttctcgctcctgggatgcatgggagccccagagaccgggacccatctggcgaaatgagcctctccccgggcgagaacgcgcctttatacagccatcgagacacccagactcacgatgatgtgatggggtcactctcactaaggcgggatctatctcacccagaaaaccccccgtttggtacctggtggacgtacactgtcgaagagacgctcttgtggccaattttggaatatcaaggcaatataaacaattgtctggatgtcattctgggagattttgatgatgagccgggcaataaggacaccggtgctagccctaacgctgagggcaacactggtccgtacacgaaagagagacgaaaacagcacttgtcttctggaataactcttggactagatgatggtgcgaccatctcggaattggtcggaagttttttgagaaatatccacaccaagtttcctattcttgaaccccaagagctgcgagaacgagggcagaacctcgtcgaaagcggtctcggttgggacggcgaaacctgtcaagttgtgagttcaaaaatgcatcttgtactgcccgagtatcgcagattacagtactaacggataacacactgaaccagctactcgcctgcgctctcggtgccatttcatgtccgtgggatgttgccgatttagaaaattacgaccgaataaaaccttcaagagaacgattgtcgctcgccaatgagtacttctcggctggtcaaaagcgactgggtgccctgttgacgcaatcgtcgataattgctgttcagtgcatatttatggctggcctctttctcatgcatcaacaaaagcctgtggcagggtggagattattgaatgtagcttccattgcctgtagaacctacatctcaaagagaatggcacgagagagtaggaacggacaggcaagcagatctagaagcatggaacagcgtctttgttggagctgcttcaaaactgaacggtaagatatcaactcactactagtacgacaacgaactgatcttgtgcccctcaaagtgaagtagcatgtgagtttggaatggagacatctggtctgaatgtcattgcatattcgacatcactgccaactccgccgaacggcttcagctctgaaatgcaagactctacagaacgccaattcgtgagctccagtgctacagccgcgacctcgaccatacaggagacttaccaagacaagtcgtggtattattttctcaccgatatcatgctctgcaagcttgagatgcgcatcgacaactactgccaagacaagagaagagaggcttatcacttcgccggaggatcgcctgaggtcttctttcggagcatgaccgaagcactgcaggagttcagataccagctctcatcatactacaactccctgcccccacttatgcaatttcccatgggcgggttgattccctgcgaggacgaggccccgaatcagcttcgctggcgcatatattgtgtccaacatgatatttacatacctgcgctgtacatcttactccataaagatgtgtctggatggtcgcataaccttgtcaatgatctgattgatctggctaacgaatgtatcaagctggatgtgatctttctcaagaccgcagtcactcctcatagacagtataacacctggctatggttgagaaaaggagttcgaagcgccttgattctcatcgcctcacggcgactgaaggcccagcgtaggcctgggctggagaggttagaagtgccagatgacgcgacatgtgcggatggagcgaggagacttgttcaaggcttgagatattggtcggccgagtcaaacgattgcaaagaatatttagcattactttatgagcttcatgcagagttccgggtatagttacaggatatttcatggaaaaaccgcagaattgttgcaaatagtggtgtaaagatctcgcaaaagatctgcatgtacgatgcccaaccctggtacgtctgaattgtttcttaaccaattctccaatatcaggatggagtcttcctcgtctaatcgaccatttggcgactctgtgtcacccatgcattgcattgatgcaatgagcattagccctaggcttaaacatgtctctaccttcaaccagcccatatcaagtaccatcactcgtgatgtctgtgtatttgaatcttcaaggctgagaaacaatctaagccggctgacgacaaggttgcgatgctgtagcatcatggaatgaaattgggtgatgtagtattgctgcaccacatccgaaaggccctgttgatagtgagatgaccctggggccttggacagctgcaacaacggcagcctttgtaggtttaaatagagcgaggggcgcaaaacgagctctcgggcctctagatactgccactgtagcagcatgctctgtgccttaatttctgatcgttcgtcaggtgtttctgaacaatctggaagagggtctggtaataaaaatttaaggttattaggcaggcttgtgtaccaatcatcgagcgattgacctgtcgcaagtaaattttggtggagtgtgcccagttcttgggcagacatctcactactgaccattttggagacatccactatgctctggcggattgataggagagatttcagtgattcagtgatggtaaaatgtatctggagacttttgtttccgtcttgtggattgtaagaagtgaaagtagacaatagtgtcacttcgcactgtagtcggctggagagccagagaaacacgatgataagcgagggtccttaataaatggttgcgcacaagcttcacaataaactcactatagcaaactgatacatatgtaccggatgttgtcgcatagttcgtcttgttgtcgtcggtggctggcttcgtcgccaatagaagggccgtgactggggggcgttgtgtcaatggtcagcaatgagccgttgagcatcttaaaggctgcagtaggttccgatgtatggatataccagatgctggctgcgcagtcagaaagcgggtaaaaacgaataaaggggaggtccatacgctgcaagaagctggcattgagccgctaccattccagacccttcgaaagcccaggcgagacgtttcttcgccatgttccaatatctcaaagccatgctgactgtggatgacgcatgctgagggaaggctgaagtcggtctcaacatactcgccagagctgcaactatcaataccaagcaagcctccacattccacatgtctccatattccccgatatgcagaatatatcggcgaagatctgccgcgtctaaaacagggatggcaggcaagaagccggcttggaagacgtctacaagccctagaagagtttctgtggcacaagtggcactttccctccccgttgcttgagacaaagggtgctggcccgggtggactcttagggcttgcttgtagcgagctagaggccctctatcgccttgtatgttgaatacctgccattcaagaatggaggataggcctattattgggctacggcctgtgggaatacaatcggggcctggattcaacccttgggcaggagggtgagttacacccaggacggaattgataggcagggtcggaggtatggggatgttgtcaatggcatccaatattcttgcaccccattcatcgaggttcgaggatgagctgttgaacaaaagggtgtttgttggttagtaaattgacttcatgcattaccactcgagagaggattctcacgtagagatgacactggggccatattcgcaagctacgcccgccttgaagcaatacgtgcacgttggctgatggccgctgcaacgagtcttgcgatcacgacatgctcggcaagcaatggccgtccgcaagggagaagaggagtctccactgactcgatgacgcttgttgctgccgctgctcattgtcgccaagctagcaagcccggtttatttctcaaacgattgctctagccctggctatcggatgaaggagtattttgctctgttggcggatgaaaggacgtgtccgaggactcatcgggaaagccccgaggcagttcattctcagtctcgtccaaagatttgggtattgatcggtcctcccccgatgccaggttagtcggcactaaagatctgaagatccttcttgctcgtctggtggatactggagtcacctgataacttttcaaacggagatttccgatcggctctcccccgaagcctgagtagaactaccatcaatgttatgggaaaattacttcctccacttacgccatccttgttagcatctggagtcgtggctggccatcctgggacagtgtccatcgatgggagcataaacgcgcaaaattccaataatgggttct
